United States Patent 7,319,142 (NUCLEOTIDE AND AMINO ACID SEQUENCES FROM XENORHABDUS AND USES THEREOF) - sequence listing, part 5

SEQ ID NO: 16889 - DNA, 178159 bp, Xenorhabdus bovienii
  unsure (1)..(178159): unsure at all n locations
atttttagatcatgtacatgccaccattgacatgtaatgtttcacccgtaatgtaagcggcctcgtcagaagcaagaaacgctacagcactggcaatttcctttgcatcaccgagacgactggcaggaatttcagataaaatgcctgctcgttgatcgtctgtcaacgctctagtcatatccgtttcgataaaaccaggtgcaacaacgttgacggtgatgccacgagaagcgacttcacgagccagtgatttactgaaaccaatgactcctgctttcgctgccgcgtaattcgcctgccctgcatttcccattgttccgacaacagatccaatggaaataatacgtccataacgttttttcatcatagaacgcattactgcttttgacagacgaaaaatcgaagaaagattagtgtcaataatatcttgccactctccatctttcatacgcatcaacaagttatcacgagtgatgcctgcattatttaccagaatgtctatttcaccaaattcagcacgaatattcgagagtgctttttctacggattctgaatctgtgacattcaatacaaaacctttgcctttatcaccaaggtaggcactgattgcttcggctccattctcgctggttgctgtgccgataacacgagcaccacgttcaaccaataattctgcaatcgagcgacctatgccacggctagcgccagtgaccagtgcaatttttccatcaaagctcatgttttcctcagtcatttattcagagcaactgtgagtgatgatacatcatttactgctacagcatttaaagtatcaacaatccgtttcgttaaaccagttaataccttacctggccccatttccaacagttgttcagtaccttgtgccgctatatattcaacggattctgtccagcgtacaggattatacaactgacgaaccagtgcgtcgcgaatcgcatcagcagattcttctactttgacatctacattattgacaacagggaactgtggctgattaaacacaattgattgcaatgcagcagctaactgatcggctgccgacttcatgagtgcacaatgtgacggaacgctgacagccaaaggcagagcacgttttgcgccagccgctttacaagcagcacctgcacgctctacagcctctttttcacccgcaataacgacttgtccaggcgaattaaaattcacaggtgaaacaacctgaccctgtgcggactcttcacatgcctttgcaatggattcattatccaatccgataatggcgtacatcgccccttgcccttctgatacagcttcctgcatcaatttcccgcgtaattcgacgagcctgatcgcctgctggaattcaatcacaccagcacaaaccagcgccgagtactcgccaaggctatggccagccatcatggaaggctgcttgcctcccttttgctgccatatacgccagatagcaactgaagctgcgagcatggcaggttgggttttccacggtttattcagctctttctgctggcccctgctgaactaatgcccataaatcgtatcccaagaccgcagaagcctctggcaaaatctggtccaccaacggaaattctggggctaaatcagccaacataccaggtgactgagaacctggacggggaacacccattgcgaatcagacatgtttattttcctgttaattaaanaacgtcctagcgctgagccccaggtaaagccancgnccaatgcttcaattaagacaagctggccgcgttgaattcttcccatcacgttccgctttcatcaaatgccgtcggaacagatgctgctgaagtattgccatgacgatcccagtgttacaacccncctttatccatcgtcatgtccaatttcttggcagccgccgaaatgatacgtaaattcgcttgatgtggcactagccagtcaagctgagaatgatccagattgtttgcttccagtgtttcatcaacaatactggtcaactcacggacagcaactttaaatacttcattgccagccattgtaacgtattcaggtgaaccccatttcaatcgatcctgattaggtaatgacagtaaatcgccatagcgaccatcagcatgcaggtgggttgacagtatacccggctcttctgaagcccctactaccattgcgcctgctgcatcaccaaaaaggacaactgtactgcgatctttagggtcgacaactcttgagataatatctgccccgataaccagggcatgtttaacctcgccagccttgataaatttatcgacaatgcttaacgcataagtaaatccagcacaagcggccgcaacatcaaaggcggcgatacctcgaatgcctaatgaattctgaatctggcaggccgtactcggaaacgcatgggatgaagttgttgttgctacaacaatcaaatcgatttgtgttttatcgatgccagccatttcaatagctttttcggctgctttgaatcccatagtggcaacggtttcaccctcagccgcaatacgacgctcacgaatgcctgtacgagtaacaatccactcgtcagtcgtatccaccattttttctaaatctgcgttagtacgcacctgcggaggcaaataactgcctgtacctaagatttttgtatacatttatgcttattcactcttgggtaatactgcatccagccggacagcgattctatcaggaacctgattctgtacggtctgaactgcttgatctatagcagccttgaacgcacgttcattcgcggcaccatgactttttatgacgataccacgcaatcctaatagtgttgcgccgttatactggtcagggtttaggtggccgaagcgttttactatctgttttaacaaccacttcttgaatactttcctcaaccacgatgattttttcttctgaccatccggtgattttaccaaagataaaatcaccctgatcgcaccttccatcgtcttcagcgtaacattacctgcgaagccatcacacacgagtacatcggtttttcccgtcagtaactcattcccttctacataacctatataattgattgctgaggtattctgtaaggtcatagcagcttcgcggatattatccagccctttggattcttcctctccgatattgagtaatgccacacgcggatttttcacacctgcaacatcctctgccattactgctcccataatggcaaactggactaacatacgactattacaatttatattagctcccaaatctaatataacagttttctgctgttttaaattagggatcatcgtcatcaatgcaggccgttcaataccctcgatggatttcagcatcaatttggccagccccatcaatacgcctgtatttcctgcactgacacatgcctgcgcttcaccagttttaactaaatttagtgcaatacgcatcgaagtaccatgactggaacggatcgcctgagaaggttttgcatcgttggaaacaacgtgttccgcaggaataatttgcaaacgactaagctgctcagcatttttatttgcaagcaaaggggagatggtttcgggatctccgaccaacaataattttaattgcggattagatgccagtgcctgcaatgcagcaggcaccgtaacgcgaggaccaaaatccccgcccatagcatctaacgctaaggttagattagccaagatatcaacttgctaatagttagctgaattacttgttgattaccttgcggccacggtagtaaccgtcagcagtcacgtggtgacgcaggtgagtttcaccagaagtcttgtctacagagacatgtgttgcagtcagtgcgtcatgagaacgacgcataccacgtttagaacgagttggtttattctgttgtacggccattgaccttactccttaagtacttttctttaaactggctaatgcggcaaatgggtttggtttttctgcttcaggaggcagtacaccaaataccatttccgcgtcggacacttcacagtgttcagaatcatgcaccgggactaccggcagagaaagaattatttcatcttcaatcattgccagcaaatctatttcgccaaattcattaatgttgattggctcatactcttccggtaatgcctcggcccgttcatcattgatgaccggactaaaacaatacgttgtgtgaacatgatgactgaaattactgccacaacgctgacaggcaagtgtaacatccacatcggaatgcccttttacaactgccagacgcagattatcaatttgaaatgataatgagctatttatatcaccatccacactgaccacagactcggcgagacgagaagcttgttcagcagaataactaccttcgtagtctaagcttttctgagctgcacgaagcgcatcaatggtcaggggtaattttaccttctgcataaggcgcgcatattatctttgtaatggaacatagtcaaagaaaaaggccacacatctgcacctttccgccaaaaattcgcttattaagcggggtatagtttaaaatgtctgggaatatttctctacgtattttatggaaaaaatgatgcttccgattgttttatcatcaacatcgatatatcgccacctattgttggaaaaaatggggttaccttttgtctgtgccgctcccaatattgatgaaagcccacaagagaatgaaagccccacacaactggtgatgcgcctgtcacaggcaaaagctaccgcattacaaccgagttattccagccatctgattataggttcagatcaggtttgcgttttaaatggaaaaattacaggtaaaccacacaattttgagaacgctttcgcacaactcaaaaaagccagtggacagtgtgtcactttttatactggaattacgctatttaacagcaaaacaggaaacactgatacccgctgtgaattatttcatgtccatttcagagatctgacagaacccgaaattatcagctacctaaacaaagaacagccttttaattgtgctggtagctttaaaagtgaaggtttgggaattacgttatttaaaaagctcgatggcagagatcctaacaccctaatcggtctgccattgatcactctaacagaaatgctcatccgccaggggataaacccactgacggtgcgttatcaataattattttgtcgtaatgttgttaaacattgccgtagctcatcatccatttgagcttcgaaacgcagagtttctcccgtggatggatgagtaaactttaatgaactggcatgcagaaacaatcggttaagccctgtttctgtcagttgtgcatcaaacgccctatcaccatagcggtcatcaaatgcaataggatgaccagcatgtaaggtatgcacacggatctggtgcgtacgtcccgttactgggcttgcgagcaccaaggtcgcaaactcataccgttcttcaactttaaaacgtgtttccgatggtttaccatcgccgctgactttcactacccgctcaccactttgcaggatatttttcaataaaggtgcctgtaccactttgcaatgtgactgccactgccctcgtaccagagcaaaataatctttctgcatctgtttcaaccgcaattgttcatgcagtgcacgcaatgcagaacgcttcttcgcaatcagcagaacacccgatgtatcacggtcgagacgatgcaccagttcgagaaaacgcgcttcaggacgtaatgcacgaagcccttcgattacaccgaagctcaatccgcttccaccatgcaccgcggtacctgatggtttattaatgactagtatgtagtcatcttcataaaggatgcattctgccagaactgctactttgcccagcttggcagatacaggtggctgctgtttttccgctaccctgactggtgggatacggacaacatcagccgctgctaatttatactcaggcttgattcttcctttgttaactcgaacttcacctttgcgcaagatccgatagatcatactcttaggcacaccttttaagcgcgccagcaaaaagttgtcaattcgctgaccggcttcatcgtcatcaatagtgacaaactgtacaattggattatttgttttcataagcaagattttaattatccgtcaatcagagcgccactcatttttaaatatgtataaataacatccatagtttcatttctcattgtttctaatgtcttaggataaagaccaaagattaacaacttatcactatttcctgataaaaaactgctaaagcgataaagtcaccttgctatcaccccaatagcaatggaataatgctttctggccacagtttactaaactatgaatggcaagattgaaattgtttgttatctgtctgatcgaacaaaaacgcagcaatggcgtaagacgtaatgtttaatcaaacaatttatgggctgcgagttgcagcttactggattgggtgaaatctgtaccagtttattacagtatcccaataaagagtgctgtatttaaatgaaattcagactcgccgacaaatataggcgcctctatacaaacgatagccgtgaggctggcggctttgtaaaagacacgaggccatcggttaccagtagtgcatctctttttgctcgcagctctataccaatgtaaaaaataatgagtaagttagaatgaaaagaatgctaatcaacgcaactcaacaggaagagttgcgtgtcgcccttgttgatgggcaacgtctttatgatttggatattgaaagtcctggacacgagcagaaaaaagcaaatatctataaaggtaaaattacacggattgaacctagtctggaagctgcttttgtcgattatggtgcggaacgtcatggtttcctgcccattaaagaaattgctcgcgagtatttccccagtaattatcatgctcatggccgacctaacattaaggatatccttaaagaaggtcaggaagtcatcgtccaggttgataaagaagaacgaggcaataaaggtgcagccttaacaacctttattagtctggctggtagctatttagttctgatgccaaataaccctagagcaggtggtatttctcgccgtatcgaaggtgatgaccgtatcgaattaaaagaagcgctctcctctcttgaattacccgaaggtatggggcttattgttcgtactgccggagtaggcaaatccgccgaagctttgcagggagacctgaatttccgcctgaaacactgggaagctatcaagaaagccgcagataatcacccagctccgttcctgatccatcaggaaagtaatgttatcgtacgcgccttccgtgattacctacgcccggatatcggggaaattctgatcgacaatcctaaaattctcgatttggcacgccagcatatcactgcgcttggacgtcctgatttcgccagcaaaatcaaactgtacagtggtgaagttcccctgttcagtcattatcagatagaatcacagattgaatcagctttccagcgtgaagttcggctgccttctggtggttcagtagtcatcgatacaactgaagctctgactgcaatcgatatcaactcatcccgggcaacccgtgggggagatattgaggaaacggcctttaacaccaatctggaagctgcggatgaaattgcacgtcaattacgcctgcgtgacctcggtggtcttatcgttatcgatttcattgatatgacacctgtacgccaccagcgtgaggttgaaaaccgtttacgtgatgcagtacgtcaagaccgtgcccgtattcagattggccgcatttcccgctttggcctgctggaaatgtcacgccagcgtttaagcccatctctgggtgaatccagtcaccacgtctgccctcgctgtagcggtacaggaaccattcgtgacaacgaatcactttctctgtcaattcttcgcctgatcgaagaagaagcactgaaagagaatacacatcaggttcatgcgattgttcccgttcagattgcgtcctacctgctgaatgaaaaacgtaaggcggtcagcgccattgaacatcgccaaggtgatgtaggtgttgttatcgtaccaaacgatcagatgcaaactccgcatttctctgttttacgggttcgtaaaggtgaagaaatttctaccctgagttatctgcttccacaaatacatgaagcagaaatgacgaatgctcaggatgatggacaacatgaacgcaagcgtcctgagcaacctgctatttcaacttttgatctgcctgcagaaactaccacccctgtggcagcaaaaacaaaagagaaaaaggtagcggtgagcaataatcagcaaacagaacaaccaggtctgttcagtcgcttcctctgcgccctgaaaaaaatgttcagtggtgaaagtggtgaagaagaaaaacaggcgcaggaaaagagcaataaatcttctagtaacgataaccgacgttccccagaacgccgcaattcacgtcgccagaatcaaagacgtgagcgtaacgagaatgacactcgcaataaccgtgagcgcggcgatgaacagcgtaaaggtcgcaatgttcagcagaaaaacaacgcgccggataatattgcggtaaatgtagatatagataatgaagctcgtgaagcacagcagcaacagcgccgtgaacaacgggcggaacgccagcgccaccgtcaagaagaaaaacgtcagcagcaactggaaaccaaggctcaacagacgagtagacctgaaattacagaagaggaagtcgaagagcatcaacctgtaatgcctcgtcgtcagcgtcgtcagcttgaacagaaaattcgtatcacagataacgtgaaagaagaagctgttgttgtctctttaccgattgtaacaaaggtggtcattccggcgattacagaagaagagaaaaaagtttctgtaccagccattatcgatacgaatgtagaagcggctaatcagccttcaataccacaaggctcaatcacgcaaaataatgagcagcaagacaacatcatgcctcgccgctctcgccgttcaccacgccatttacgtgtcagcggtcagcgtcgtcgtcgttatcgtgatgagcgtaacctgactcaatcacctgtaccactggcaatggcagttgcgtctccagagttggcatcaggtaaagtttgggtgcgttaccctgttacacctgtgacaaagcctgctgaaccagaagtatctgctgtggaagaaacagcgtcagagcagcaagagagtgtcatgccgatacctgctgttgctggttcagtgtcagtttcaactgttgctgatactcaggttaccgagcaaattgcagccactcatgacgatgttaagcttgcgaccaatggttatccgctcgtggcatccgtagaacctgtgcttgaaaaacctgaagtatcggcaccggaaaacctggaacccgtcgtcaaccatgaaactaaacatcagcctgaagccttaaatgacacggaagaaacacgccacatagcagaaccaatcattgtgacgtctatcgttgaacaggaacagcatgaagaacagccaactgtcgcaacggaaatatgctctaaggcagaggaagttaaagcggaagagacaaaaattgctgagtctccgattatcgtggaaaaaaatcatcacgcttcttccccaatgacaaaggcaccagcaccagacttagtagtacagactgtcattgtcagcgaatggcaacgccctgcttatccattcagaggaaaaggcggcgcgggtgggcattctgcaacaaatgtcgcaatatctgcaatgtcaaaaccgcaatcatttgaataataattggatgttgtgattctcagaaaagtaaaaatccgccttcatagaaggcggctttgatttcgccccagaggggcgttactagttcagactctgagagccttcacttcacatcccttttaacgataattgattgtcttcatgttcatgtttttcctgatacttcacatacttccttatcatttcttcatttacacctacggtatctacacagtaccctctcgaccaaaagtgatttccccataactttttctttcttaaatagggaaatttattaaataatcgaatggctgttcgtccttttaaatgcccaagcacctgagatacagataatttcgggggtatttttaccaaaagatgaacatgatcgagttgaacattcaattctacaatttctatctcgagttgttcacatgaaatccgtatctgcttatagacctcccttcctacattatttttcagtattctaaatcggtatttgggcgtccagacgatatgatattgacaacaccaaagtacatgcgatgctttcttgaatctactcatggttaaatccttctctgttatggggataacagttcggattttcccatgagtagccttattggcagagcccatctgttgctgaccacctccgcaggaggtggtattcagttatgaatcaaaaatggctcctctttatggagccattttttatcattcattctataaaaaacctgcctgtctcatttcattcactctctgatttcaataaacttagataattatcattatcattatcatttagagttgttgatttttatggagaacattccgactatgaaatcttggctaatttttggtgctggcagaggcgttggacgccatttagccactatggcactgcaacaaaaccaccccgttacggcattagttcgtaacgtacagcaagccgtggaactgagtacaatgggcgctaatgtgatacatggcgatgcctgtgacaaaaagagtatcgaaaaagccattgctcaggccggagaaaaccctattgttttctcaaccattggcggcggaaacgctgatcaccatggtaatatggccatcatagatacattggaacaagctgaagtttcacgcatgctactggttacatccatcggatgtggagacagttggaaaacgttgtcaccacgtgccaaatcattatttgggcaatcagtcagacataaatcgctggcagaaagttacctgcaaaccagcaaattggattttacgatcattcgtcccggaggactcactgataaatcaggtactggacattgccaacgctatcaaggtgaagttcacggtatggtgagccgagaagatgtagcacaacaattggcactgatggctgaagatgaggaaacttattaccagatttacgctttagtcgatccagagttaaaacctcactggggctgacaaaataaccacgcccaaagggcgtggttacaacaaaattttattttactccgccatccattgccttaagttttttggacagctcacgacgctctttagacaattccgcatttttgatgatatattcatcaacacgttcttcataatcactgcgcatatgagcgataattccttgaatatcttcaactgacattcccggtttaatgtaatcgctcaggttatccagcaataatacacgcttttggttatctcgaactttcttctcgttgtctactatttcgcgctgtaatttattcttgcggcgaaatatacgcacaaattccagtacattatggaatgttggtttatttgcgttgtccatttttacaccttttttaatcagaccgataattttttatgctgactacacaatacaatttcaagtaacgaatagacaagtcagtttcgacaatttattgacattataaactttaagtatattccttaatcaatcattttcatcgtcctagcatctgatgaccaagagtttccgctgccatgagaggtttcagtacctatccgaaaagagacttttctccgcattagaaacatgtgaaatgataatcaacgattttcaccctatatcattagagagttcagattgtccaaaatatggtttaccatatctttttgcatcgtagaaaccaaagatttagtacacaacttgtcataaactaaaccgtgcaataaaacttttatcaacatgatcaatacacaaaaaataagataacacattgaaattaaattaattaaaccaataaccaacggacgcagaattaccttgagtaacgataaaaaccccactttctattttcatgattatgaaaccttcggcaagcaccctgccttagatcgcccagcccagtttgcgggaattcgcaccgacagtgattttaatatcatcgaagagcctttggtggtgtactgttcgcctactgacgattatctgcccgatcctgaagctgtgatgatcacggggattacaccacagttagcattaaaaaaaggggtcaatgaggccgaatttacccgccagatccatgaagcgttcagcaagcccaatacctgtattatcgggtataacaatattcgttttgatgacgaagtcagccgaaatatcttttatcgcaatttttacgatccttatgcttatagctggcaaaaaggcaactcccgctgggatctgcttgatgtattacgtgcctgctatgccctgcgcccagaaggcattatctggccagaaaatgaggatggtctgcccagttttaagctagaaaacctgacgaaagccaacggagtggaacatactcaggctcatgatgccatgtccgatgtttatgccactattgcgatggcaaaacgggtaaaaaaagcccaacctcgcttgtttgattattttttccaattaagaaacaaacagaaggtcagtaaccagattgatattccgcaaatgaagccactggttcatgtatcaggaatgttcggaactctgcgcagcaatatcagccttatagcacctttggcatggcacccgacaaaccgcaatgcggtcatcatgtgtgatttggctggtgatatttccccgttactagaactcagcgcagacgaattgcgcgagcgcttgtatacccggcgtaatgaactacagccgggccaagctccagtacccattaaattgatgcatatcaataaatgtccgattattgctcctgaaaatacgctacggacagaagatgcggaacgagtgggattgaatcgcgatcaatgtgcaaaaaatctggttatattgcgcagtaatccgcaaatcagggaaaaagtggttgagctattttctcaaccagaggaattccctgagtccgataatgtcgatgccaagctgtatagcggttttttcagtgatgccgataaaaccgcgatggaaattatccgtgaaaccgcacccaaaaacttacctgcactggatttaacatttcaggatccacgtattaaaacactcctgttccgttaccgcgccagaaactatccggcaacgctggattatgatgaacaacagcgctggctatattatcgccgggagatattgacacaggaaagtatcagccaatatcttgcgaccattgaacagctctttgttgaatatcaatctgatgaagaaaagtgccgccagttaaaagcgctggttgattatgcagttcagctggctggctaacggccccgcatcatactggcttattttggaaaaagaaaaagacaagatgctctattttgtctttttttctcatcactccagcatcattatagtttaaccatgtcgatgaccggaaagctaacaatcacactttccgtcctctcttccccaatttttcagcttggaggttttgccaatacccggattcaaagtattagtgggatcagtcatctgataaaactgtttaagctgctgtttagcttgatataaatggccaacgttatgttcagcaggatattctgctcctcgctggttcaggatctccagcatttttactttcagtgtatgaacatctgtgccttttttaacaatgtaatcctgatggaatacgtagcacataaagtggccgtaatacaaacgatgtaccaatgcttcatcaatttctggcggtagatgctcaaaccattcgtggtcattgcggcgcagggcaatatccaatgccaaaatatcctcaacttcattgctatgaacagcttgataccgaatagccgctcccgccgccgcaaaacggtgtaaaaatgcctttgcgccctcttctggcgtacaggcgaaaaattctccctcggcttgtttaaagtagctttccagccactcactagcttcttttatgccttcaccagacatttttaacatcaagtgatgttcgaagcgatttcggtactctttcaaacgtgcgggcaaatgtgaaggtaataaatggctcaagccctgtattacgcgatctgtcaggtgtgatggcaaaaaaggaattttgctaaacatggcatctatacgccctttcaggctgaaaaacattggcattttatccgtacccagtttatcaatcatgataaaagtgtctttaccatacccttcagcgatatcaaaaatatcccgatgcatatattcgccagcaatcggtaaatgctggaaattagctaatatatgtcggcgtaattctgtcaatacttcaggttggttggtaccgatatagaaaacttgagaagaagactgtgcaggaaaagtatccaaacggacagcaaaaataactaatttacctgcacaaccagaggcttcaaacaaccgacgctcatcggcattaaaacgtgatggggtatctgcattgatatctcgaacacgctgctcatactcatgatcagaagcaactcggtcatccaactgaatatcctcagctcggtaacgctgttcttccaagcaagtcagaatatcttctggcgtattccctaacgatatacccaaatgattaatcagttcagcttgccccttctcattcacacggccatacagtgccatttctgtataagctgggccacgctggaccaaagagccgccagagttattgcagatccccccaacaactgacgcaccaatgcaggaagagccaataacagaatgaggctcacgacctaacggtttcaagaccttttccaggtgccacaatgtacttccaggaaatgcaatgacctgattgactgatttaagaacctgtattttatccatccgcagtgtactgataataacaatatcgcggtcataatcatcaccgttaggtgtggaaccttccgtcaatccggtattagctgcctgcattaaaataattttgtcagctaaaatacaggctttgaacactttccattgctctaataatgaagccggaaatacaacagcaagggcatttccctgtccagagcgaaaacctttgcgataacgttctgtttttcgaggttcagtgagaatatgagaagatccaacaatattagtgagaattgtaatgagttgctggttttgaggacttttagcatcattcataatggttttcttacctttacttagcgctagatatataggctcttaatgaaatcacgcatggcacagttgatatttattatatgacgccttttggtgatttttatgccattgatattctttttttatttcaattaaaaacagcaccctaagatgctgttttataaataaatatacgaataaagcttacactgattcagtgaactgtggcattggctgacggaaactgcgggtcaggaagaacatataaataataccgattcctccccaaattagacctaacttcatcgaacttgactccagattcatccataatacccccactgtcgcagccccaagaactggcaggagcaaaaagtgaatcgtatctttcagtgtgctgttacgcttttcacgaatgtagaactgcgaaatcactgacagattaacaaaagtaaatgcgactaacgccccgaagttgatcaatgcggttgctgttaccaaatccagccaacccgctgacagagcaacaatcccaaccaatatgacattaattgatggggtacgccattttgggtgaatataagcaaatactttttcaggcagtacaccatcacgccccatcacatagagcagacgggatacacctgcatgtgctgccattcctgaagccactaccgtaacacaggagaacataagaataatgtactggaacagagcgccagcaacatacagcataatttctggctgagaggcatctgggtctttaaaccgagaaatatcagggaaataaagctgtaagaaataagatactgtaataaagatagccccaccgattaatgcagtcatgaagatcgccttagggatcacctttccagcattaggtgtttcttctgacagagaactgataccgtcaaacccgaggaatgagaagcagagtatcgtcgcgccagtgatcattggaatcaacttcgcttcatctgacgtgaacggttgaatactcaataatgttccaactccttctccattgtagacaccatgaaccaaaaaaccgacgagtaccaacataacgacaacctgaacaatcacaataacaccattgagattcgcgactacattaatgccgctcaggttgaaaatcgtcatcagtattgtcaacgtgaccacgaaaatccatgggtcaatgcctgggaaaagagcctgaagataaattttcgccagtagaatattgatcatcggcataagcagataatccagcaatgatgaccaacctaccataaacccaagatggggatttattgatttttgtacgtaagtataggcagatcctgctgatgggaagcgttttaccagtttcccgtaactcaatgctgtaaataaaatggcgatcagcgcgagagcataagatgtcgcaacgtgtccgctggtcaatccggaaacaatgccgaaagtgtcaaagatagtcattggctgcatgtaagcaagccccatcatgaccacctgaaacagggtcagtgttcttcttagttgaacacgattgctagcactggtttggttagtgtcaagtgtgagagtagtattatgcgacatgagcgaaacctcccataacttcgatctgggtactaatacaactacttaatcgatagttagtgggtagacttcgcatctgtctatagacagaaaagaaagaagagttattagaagacagtgaactgacggaggaccatgccccataatcatcgttgcagcagcaagcgccaattggcacgagtgcaaaagtgaataattgctccatgtttgcgttcctcagtacagcagcccgttcttataatggccgcttatggtcagtatcgatccggaacaaaatccggcctcttggtgttgtaaaaaataactcaaagcaaaaaaataactggtgtatatttacacaccagctattttttagtgcacgcattttgcatttcacacttagaaatagcaagagctatcacactaaaaattcattattttttacaataccggagagcctgatggaataggctttcactgaacctgtgcagaaacttaacgctatcatattccttgtttggaatttaataaatttttagcacagaaggaaactatttgctatttaattgtgatatcaaaaggttcaacctttcatcatagaactgatgaaaggttgatttaatattacgtttaaatgttaattataatgattaatactaataaaaaaccgaagtattaattaaaaatcataattaatgccgatgttataacgacggccatctagtaccgcatcatgggttttctcagtaacgcgcttgtcaaagacgttgtagataccacctaatacacgcaagttcttcgtcaagttataggtcattcccaaatcaacgaaagtgtaagatggtgtaccattcttcacgccagagcgatatacataatttgttgatttacttctgaaattaatgcgagtccacgtatccatttctggtagtgcctgccagttcaaggtagcgttggccatatgttttggcattttattcaatgcctgacctttatacttaccgcttttctgctccgactcggtataagtataacttgcggctaaggacaagttttctacgatatcccaattcagggtggcttctattccacggatgttcgctttatccaagtttgtacgcttgttgataaaatcataagtaatatcacctgttggtttacatggattttcagtatctttatcacactctccaacctcagtgatcttgtctttaaagtctgtattaaagacagttacaccaacgttaaagttatcttgattattccaaataacactaatctcttcactaacacttttctctggtttaatatccgaattccctataatcattcccttaagattgctaccacccgttgtctgtccccaattaggggcaacctgtcgcaattcaggtgaacggtaaccagtagaaacaccacctttgatcgtccactgttcatctgcgtgccatacaccatacaaacgaggcgtccaatgtgctccaaagttttcgtctttatttaaacgagcaccacccgtcagagcaaaatcattggtcatttgccattcatcttccgcaaataatgcccaactccaacgtgttaatttattaacatcttttgctgaatttaatttattaccagtatctcgtaaatcttcatagcgatactgtcctcctacacttaacgtatgatcatctaatataaacgtagtttggttattaaataacgtatcgttatatttcatttcacgctcagggttatgcgattcatccctctgaacataagaagtcattgtaccgaagtcataaacgccattatgggaaatcgaatagttattacgtttatagcgacttatgtcatctttacaagattttggctggcaatcacgagttttaccaatggttgagtctcgatcctgctcataacgcccagcctcaaattcgaaagtattctgttcatcaggtgtcaaagagaacgttgctgcaccattacgcatttcctgctctctaaagccaccaataaacttatcttcattacgatgagaaaacaggccattgactttcaatcctaacaaaccatcaattaatggccccgcagcataagcgctggtttggtagctattacctgaatttttacgttcggtcagagtagtatctgcacgcaggctggtatgccactctttctgtaccttacgggtaataatattgattacgccgcccatagcatcagaaccataaagagaggacatcgacccacgcacgacttcgatacgttcaattgatgctaatggtggcaaccatccctgttcgataccagaaccatcactatttgggcgggtgctgcgagtatcaacacgtttaccatcaatcagaatcatagtatattttgaagccataccacgaatactgatatcactactactgccaccaccagtcacaactacccctggtacatctttcagtgcatccgtgacatcacgataagatttcgtttctaactgttcacggctaactaccgaaatagaagcgggtgcatcttcaatcttttgctggaaacctgctgctgtagttacaacaattttgtcttcaccattattggcagccaagactgtgccggatgaaatagcggcaataattcccaatacgatttttctttttacaaaaacagccattcccagttctccaaaaggcagaataaaattatttaataattaatatggataatcgatatacgctcaaagtacagggataattatttatccctgtcagtgttatatttattaagctttagttttaataaaactatctatttctctttattactctaattagccaattccgtcactaaaccatcaattaatacctgaggcactccctgagagcaacgctcaatgcggcctttaacaccataaacctgcgccagactatctggtgtaatcacctgttcaggtgtaccttcggcaattaactcgccttttttcagcattaatacatggtcaccatgacgcaatgcaatattaatatcgtgaacaacaacaaccgtaataatattacgacgacgagtttcacgtgccactaaatccatgacatggtattggtaatttaaatccagtgcacttaatggctcatccaataataacagtgtcggctgcctgattaatgattgagccaatcccactaactgtttctgtccgcctgataattgatccagatagctgagcgccaaatgttcaatgccaagctgacgtaacagttccatgacttcattctcacattgtttgctgcttacaccacctgatgctcgctgggcaacaatcacggattccagtacatggagatgaaccccctccggcaacgactgaggcaggtaaactacaccctgagcgcgttgagcgaaattcatctgcatcaaatcctgcccattgagcaacagttcacctctagctttattaagccccgccaatgaacgaagaagtgtggactttccactgccattaggccccagcaataccgtgatttgaccactaggcaatgacttgacattcagattttcaatcaccggatgcttaggatacccggccgtaagtcggttgattttcagtccctgattcatatacttcccttatgccgtaaaataatgctcaggaagaacggaacaccaatcagcgatgtgacgatacctaccggtatgataattccggggatcaggtttttggatgcaatagacgccatcgacaacactaatgcaccaatcaatgcgctcgcaggtaagtagaaacggtgatcttcaccaaacatcattctggcaatatgaggggcgatcagcccgataaacgcaatcggaccgacaaacgctaccgccagtgcggttaggatactgatgcgcagcaatgttcccagacgaagacggctgatgttaataccaaaactggctgcacgatcttcacctaaacgcaatgctgtcagcttccaagagttcatcattgagataggcataatcatgagaaataccagcagcataatgccgagcttttcccatgtagcccttgcaaggctacccatcgtccaaaaaaccagcccctgtaaagtgtcttctgtagcgataaactgcatcatagaaaccagcgcttcgaaggtaaacaccatcgcaatgccaaacaatacaacgccagacgttgccactcttgtccagcgtgtaatgccatcaagcatcaaggcagccagtaaagcgaagataaaggcgttggcagagatgagccattgatccggtattcccggaatgccaatgccaagcacgatggccaatgccgcaccaaatgaggcagcattggaaacacccagggtaaatggactggccagtgggttattcaggatggtctgcatttcagcacctgccaatccaagcgacaggccgatgactaccgccatcaaggcatagggtaatcgaatgtcccaaacaatcacccgcgttcctgcatcaacactttccggcgaaaccagtgtctgccagagagcttgcagtgataaccctgatggccccattgtaaaatccagtaccaaagaagctgcaatcacaaaaataataaataatatcaatgcagtacgtcgatgcaaaatatggcgatagcgtgcttttacatcgcactcactcaattgttgtttcaccattggcataggttcggtagtgatactcatttttattacccgtttactacttacttctcactgacccaatacgtgcctgctggttcaacagccaagaatttattgtgaagttctttcaatgtttgctgtggatctagatcagcaaatttttcagggtagaaccatttggcaaaaacctgagtcaccacaacgttataaggtgaattgtagtaatgatgccagataccgtaactacgcccttctttcactgcggtcaaggtattgatgccttgacgtgcagtgacagttttcagtccagcgcaggcaatatccgcagaagtttgggcacccatttgaacacccccatctttatcacccggatcctgagcaccactcgcaatataaatataaggatctgcgacaatcactttttccagattcatcatccccaacggtgacggcaatacatctttggcgatgtttttgcctccagccaagtcaatgaaattccccatgttgccattacctgccgtaccacagcaatcttcactagaacctgctcttaactcaataaagactgaaggtttctgagcttccgctatgcggtcagtgatatcggtgactaatttttgatttttttcataaaaatcagcgtaagcgttagcttgctcttcacgatgcagcattttacccagcatgcgaatgctcggtaatgtgtttttcaaagggtcgttgcggaaatcgacaaaaacaacaggaatacctgctttttccaactgcttaaccagctcactgttttttcctggcccatgcccagataagccgaaaatagccacatcaggattaagcgtcagaactttttcagagctgacactgtcagcgctggtgttacctatcagaggaatattatcaatttcagggaatttagctttataaatagagtaagtttgtgggtccagtttacggaaatcaccttgccagccaacgatacgcgctaaaggcttgtctccttccaatagtgcaagggaatggaatagacgcccttctcccaacaaaatacgattgactttttcaggcacctcaacagtacgcccagcaacatccgtgactgtttcagcccaagatgcaaaactcgccatcatagcggagcttgccagtagactgatattcatacccttcactactgctcgaaatacaaacttcactttagttagcctcttcatacgacaattatggcgctaacaataaagcaaataagaatacttatcaatgcgattaattcaggatcgccacaatttactgactatattcttcccgtaataccatgaaaaataaaaaccgccaatttcatcacagaagaggcggttttttgtaatatataaataataataagttaattaataaatatcaatttgttgatgtttattaacaaattattcattacctgtaagttttaacgatggaaattccatctcactacatttaacaaaccgagttttctttttcagtttgtagctgaaccagataatcaggaataacggaataccgatgtaagtcgcagtgacaccgtaccaatcgatattatcttgcaaaaacgcctgatagttctgccctaatgtgatcatcaaacacaacacaaacgcaaaaatcggcccgacagggaaaaaacctgagcgatagggtagctcattcaagtcccgcccttgtgctatatagcctttacggaaacggtagtggctgattgcaatcccaagccacgcaataaaccctgtcatacctgaggtattcaatagccacagatataccgtctggttgccgaacattgagctgaagaaacacaaccctgcaaccacggtagtcgcgtaaagtgcgttacgtggaacgcctccttttgacaaatgaccaaaaattttgggggccttaccttccctcgccaacgtgaacaacatgcgggtagaagcatacatccccgaatttcccgctgaaagcacagccgtcaatattactgcgttcatcatcgcagccgcagacaacaaccccgcattttcaaataccagcgtgaacgggctgacactaatatctttcacaccattacgcaataagttggggtcagtataaggaatgatcaagctgataatcaaaatggcaaaaacatagaataacaggatccgccagaatactttgcgtacagctcgtggaatgtttttcgccggatcttttgattcccctgctgtaatgccaatcagttcggtcccctgaaatgagaaaccgacaatcattgccaccccaatcatggcagcaaacccaccggcaaatggcgcatcagccacttgccaattctgccagcctgcactttcagcacctttcatgataccgatgatcatcaagatgccaacaataatgaagacaataatcgtagagactttgatcagggaaaaccagtattcagcttcaccaaaacctttaacagaaatgaagttcagcagaaaaattatgccaaggaacaacgcactccatacccaacctggcacatcattgaaccagtaccccatgaccaactgtgctgccacaaggtcaacagctatcgtaacggcccagttataccagtagttccatcccaatgcgaagccaaaaccttcatcaacatatttggagccataggttgaaaatgaacccgaaactggcatgtaagctgccaattcgcccaagctggtcatcaggaaataaaccatcaggccaattaatgcataggaaagtaaggttccaccaggaccagcccgtgaaattgttgcgccggaagcaacaaacaaccctgtgccaattgaccctccaatggcaatcatcgccatatgtcgtgcttttaattcacggcgcaaggttcttggaggctgatcccttggtgtgctttgttcttgagacattctatccctatatcattgaaagtagttctaatgtggaattgtaacaaatccccgtctcgagaatagcggcgattagcgattataagataccctcataattgaccgccgattataagctacacgattattttcgtattactagttccatgtaggcatactagatcgttattatttacaatagctcaacaatttttgtagtgcattggacatatgtttttgacggtgataaatcagataaagtgtgcggtaaagattcagttcagggatcaccaactcaactaatgtgccatttttcaattgctcttggacgacccgccgcgaaaggcaactgatacccataccatattgaactgcatgtttaatcgcttccgaatttcccaattccatcgcaatattgaatcgaggcatttgcgagaacaaaaggtgatccagcacttcccttgtacctgaacctttctctctcaatatccaaggctctttaatcaaatcttccacagtaaagtcacgctgtgaaagtgaatttttcggtgagcagaagatcatcaattcatcttccatccacggttgggtaatcaattcaggattgtgacataagccttcaatcaatcctaaatcgacgcgaaattcgacaaccgcctttatgacatcttcggtattactgatattcaattccaatggtgtatcaggatagtcctgacgatatttcgacagcatttcaggtaacatgtaattgccaatggtgctactggccgctaaccgcagcgctcccaattccagtttaaaaagctgttctacttcaccagcctgttcaagtaatgctaatgctttgggatacagcaaacggccatgttcattggtcactaaccgctttcccactctatcaaaaagcttcacacccaattgcccttcgagatccgtcagtgaagcgctcaccgcagattgtgataacgctaaatgctgagaagcctgtgtcgttgaaccacttttcagaacttctgcaaaaatctccagttgtctcagagtgatacgcatatggcctcgcgggaagcaaaaataaaagtttaagataatcttgattctagacagtattaagcaacttaacaaaagtcacacttaattaatccattttactggttatatatataaatattatcaattttattgattaaaaagcttggcatatgcttattctcaaaatacataagcaatatgagtagcaataatgtctgaaagtcaatttggcaaaatcgacaggccccagcacaatccgatactgatattaattcccggattcacactaattgcagttctgactgcaatcgctatccatgtaggcggcatgccgtggtttatcaatatgggattaggtgccctgacacttgccattcttttggggattattgtcggaaatacgctttatcctctcttgaagcccacttgtgataaaggggttcatttcgctaaacactacctgctacgcgctggtatcatcctgtacggctttcgtctaacgttccaacaaatcacagatattggtgcaacagggttactgattgatgccattatgctttcttccacctttttcattgccttatggcttggacgtacctttttgggattggatagtcaaaccgcagtattgattggtgcagggagcagtatttgtggagcagcagccatcatggcaaccgagccagtggtcaaggcatctgccagtaaagtagccgttgcagtttctaccgtggtaattttcgggacgctcgcaatatttatctatccatggttttaccagctcaatgcccattaccaatggcttcctttctctcaagaaacattcggcatcttctctggttcaacgattcacgaagtcgctcaagtcgttgctgttgggcatacattaggcaacaatgccgagaatgcagccgttatcagcaaaatgatccgtgtcatgatgctggccccctttctgttactgctctctggttttattagtcggatagaggctaaaaactttggcaatgatcaaaaaaaatccccaatcagcattccgtggtttgctatatttttcattgctacggcaggcctaaactcttttcatttattacctggctcccttatcaaacatatcattaccgccgataccatcatgctagcaatggcaatggttgcattaggtttaacgactcatgtcagcgccattcgtcaggctggaattaagccgattctgctggcattcttcctgtttatctggctgatggctggaggattaatagtcaatcaaggaatccaacgtttattgggttaagtgggaacaagcgtcaaattgcattctctgtttttgacagagattttattggcaggatgaacaatgccataatagtgaaacaaaattagaagaggaaaaaatatgaaatttgttggagcccatgtgagcgctgctggtggtgttgatcaggcggtgatccgagcgcatgagttacaggcaaccgccttcgccttgttcacgaaaaatcagcgccaatggcatgccccaccgttatcggcagatgttattgataagttcagagccaattgtgaacgttatggctatggcagccaacaaattcttccccacgacagttacctgatcaacctgggtcatcccgaagcggaagcgctggaaaaatcccgcgccgcctttcttgatgaaatgcagcgttgtgaacaactaggcattgatttacttaacttccatccaggaagtcatctcaaaaaaatcgatattgataaatgcctcgcccgaattgccgagtctatcaatatcgtgctggacaaaacacagggtgtaaccgctgtcattgaaaatactgccggtcaaggaaccaatctcggcttcaaatttgaacaactctcagccattattgaaggtgttgaagataaaaaccgtgttggtgtctgtattgatacctgccatgcttttgcggcaggttatgacttacgcacggaaaaagactgcgaagcaactttcgaagcattcgataaaattgttgggttcaagtacctgcgagctatgcatctcaacgacgccaagagcgaattttccagtcgtgttgatcgccatcatagccttggagaaggcaatattggcaatacgccgttcagctacattatgaaagatgatcgtttcaatggcattccattggttcttgaaacgatcaatccaggcatctgggatcaggaaattgcttggctgaaatcccaacagaattgattacctaaaagaagtcagctcgatctttgacatcattgatgcaagttcagtgcggctcctgatccctacattcggctggctgaccgtaagtgcagaaactgcggttgccagacgcaaagtatgttcactggtttcacgcattaataagccgtaaactaatcctcccaccatcgagtccccagccccaacagtactgactatttcacaatgtggtggttttgccagccatgcgcctgaagcattgacccataacgccccttgctctcccaatgaaatgacgacatgggcaatccctctattacgcaattcatgggcggcattaatcacgctatccaagtcaggtaatggtttaccagcccaaatttccaactcatcacgattaggttttaccagccacggtgacgcctccagaccagcaacaaaagcttcccggctgctgtcaaaaattatacaggggcaacgctgtttcaattgcagcatccaatccgcaaatgattccggtaaaatgccctctggcaaactaccactgaccaccaccatatcgcactgccccagccagtcgagagaatcactgacaaaatagttccattcttctgctgtcacatggaaacctgaaaaattgaaatccgtcacttcaccgtatttttctgtcaatttcacattgatacgagttcggcctgagaccaaatgaaagcggtttaccatattgttttcactaaagaactgctgaaatccttcctgattttctcgtcccagaaaaccgctgaccgtgacatcaatgcccaagtcacgcagcaccttcgcaacattgttccctttaccagcagcatgcaaccctgcggtctgtacgcgattaaccgttcccttggtaatatctgggcataaaccaactaaatcataagctggatttaaggtaattgtggcaactcgacgactcatcttgcccggtgtctcctgagtaaacaatcataagtaatattaagatttctctgttatttataacatcaaaattgaatcgtttcagttaaaattaccacttgattgatcgttgtgttatctcgatctaaaagtaaaaatatgccgagagaagatttcttgtcagatgacgaaaataaaaccactacagataatttaaaatctatcttcatcatcatggataaattccagccggaggaatatacagtgtcagttgttgtcggagttggtgtcatcattattaatgataaaggtgaagtcctgctgggaaaacgcaccagcaagcacgcaccctattggtcaatctttggtgggcacgtcgatccaggtgaaacttttgaagaatgcgccatccgggaaattcaggaagaaactggattaacgattcaagatcctaaagtctatggtgtctgcaataacctagaaacctaccatgaagaaggaaaacatacagtttctgtctgtttattggcacatcaccctggaggtgagccacaactaatggaacctgaaaaatgtgagcagttaatctggtgtgatcctaatcagctaccagaaccccactttgaagccagccgcaatgccatcaagctatggcaaatggaaaaattctatcttatcgcttaaaacaacccatcttctcaaatgcttttcaggcgggttatttcatataacctgctcccacatttgtatgaaaaatacaacaaaaggaatttacttatcatccataaatatttgtttacacatatcattcattaacgtatcgtcaagctagtacaaggtagtactattaattaggagtctatatgaccattgaggtaacgcaaaatttaaaacgtccctccatacttggaggcgcaatgatcattgccggtactgccgtcggtgcaggtatgttttccattcctattgctacttcaggcgtatggtttacaggatcaataattttgctggtatatacttgggcatgtatgtacttctctggcttaatgattttggaagctaatcttaattatccgtctggctctagtttccatactgttactaaagatttactgggtaaaggttggagtaccctcaatggcttatctatcgccttcgttttgtatatcctgacctatgcttatgtttcagccggcagctcgattttatttcataatattacgcatctccttcccctgcctcaatcgggaactgggttgctgttcgcactgatcgttgcctttattgtctggatgtccaccaaagcagttgatcgcttaagtaccattttgataggcggcatggtaataacatttattatgtcagttggaagcatgtttaccgaagtcaaatcaactgtcttatttgatcaagccaatactgaaaccagctatttaccatatactttcatggcgctaccttatctgctggcctcatttggctatcacggtaatatcccaggtctggtgaaatattaccataaggacagtagagccgttgcacacagcctgttctatggcacattaatcgcattggtcatctacattttgtggcagtatgtgattcagggaaatattccccgtgaagccttcaagcagatcatcgccgatgggggtaatatcgcgaatttactgcaacagatggataatacgtccaacaatactaccgtagcccaactcttaaatgctttctcatatatggcattggcgagttcattcttgggtgtatctctgggtctgtttgactatctggctgattttttcggattcgatgacagtggagaaggtcgttttaaaaccgcactggtgacattcattccgccaacggtactggcgttaatctttccaaacggtttcctatatgcgatcggctttgcaggactggcggcaacgatttgggcggttatcgttccagccctgatggctcatgctagccgtgtgcgctatccaaacgccagctatcaggctcccggcggtaattttctgattgcttttatcattctgttcggactgataaatgctacagctcatattctctccttatttgatgtgttacctacttatcattgatatgtcccccatgcctcagtatttttactgaggttttcatatcacctcttgcctaatgtgctgactgcgagtaattttgtcgtcacttcaatattcattccattatttccttgtttttacggaaggtatctatggctaaagccaatgaaattaagcgcggaactgcaatcagttacaatggaaaattattattagttaaagacatcgatattcagacacccagcgcgcgtggtgccagcactctgtataagatgcgctttactgatgttagaacgggtcagaaagtggaagagcgtttcaaaggtgatgatattctcgaaaccatcacattgacccgccgcagcgtcagtttttcctatattgatggtgatgaatatatcttcatggatgatgaagatttcaccccttatcactttaaaaaaaatcaaatcgaagaagaattactgtttattcctgaagaaggtttgccgggagtgcaagttttaacaatggatgggcaattgctggctctcgaattaccacaaactgttgatatgatcattgaagaaaccacgccgagtattaaaggagcatcagcaagtgctcgtacaaaacccgctaaaatgagtacaggactcactattcaggtgcctgaatatctgagttcaggcgaaaaaatccgcattcatattgcagaacgtcgttatatgggacgttgtgattagttctatatccttaaaatattaattgctctttccctttcgatgaaaagagcaattcatcacctattaaaatcagaagtaatccacattaatgatcgccacacgtttttggctatcagtccacttcacactggaaacacctatattaccaggaagcatgacctcgccgattgttttctgagttgaaataatttgctttacagtaaggcttttccccaaccgatagcaagagatattagcctgagtattcgatacgacgacttgacatcctgggtcaacaatagaacctgaaaactgaatttgccctcctgtagattgcgcatatccataagacatccatgaaaccaacaaacagctaattaacaatttaagataattttgcatggtcacctcactttcgtttttccattaactaaaactcagttacctttattccttcatctccatcataattatttcacaggaaaaaatacaacattgacacattttattgattcatatcaaaaatgaattttcagctcaaaaaaagatactatttttattaagtcatttacaaaacggttattaataaccattattcaaacaaaattataaaaaattttacaattaataattatatttataaattaaataaacaatatgattagaaaggtattatataatttttagtgataagtgatagtaacaattcctgacttcttgttttcttccatccaccttatttcttctattccaatatgctttgataatgggtaatcactatctttttgatattctaagtttttatcttgattaatctgttcgccattgtgccaacaggctacttcagtacgttcttcaccccaattaaactgacatggaggctcaacaatagcgccatgaaattgaagagacccaaaacttgaggatagcggatcatgtgccattacaggataaagcaaaggtataaacaaaaaagtcgtcatttttcgtaacataagcatttaacctccactacaggtattattatcttttttcaactttagccccacgctaaattagaaaaccagataatggtacaacgctctgctatctatataacgatataacggaaaatgaaacaatttctttatgatttttatttataaaggccacatttcaacataatattctaacaagttaggatatggggaaagcaatttgtagttatttaataatagtcagtgctcaaaattgagacaaatatatattatcggtactgaagtggggatttagctatttttccgatattacaaaataattcgcatattaatgatagttacgccagtccataaatggtataaatatgctgatatctccatgtcttagcaacaacatgccagagcgattactctttgccataaattttgctatagtgctcccccagttaatttgactaccaccaaaatttactttcgttttaaataggtatctcatgacccgcagtaacccattatctatatttatacttaatatgctcggtattgccctgtttttctcatggtatttgcctgagaatcacggtttttggtttaacattgatgcagccatttttcatttctttaatgaaaaactgcttccaaattccagatttgcactgtttgtcgccatcgtgaatatcagggcatttgatgttatatcgcttctgtgtatgggcttgctctattacagcgcatttcgcaaacaggactatgcgggtaaacgccgtcttttcatgatagggctggtaatgttagtcactgctgtcattattaaccaaataggccacaaaattcccgtcagccgcccaagcccaacattaacattcgaaaatattaatcgcgtggacgacatgatcagttggcatacaaaagatgcttccaaagacagtttccctggtgatcatggattaatgctattgatttttagttgttttattcttcgctatgtctctcacggcgcatttttcattgccctgctgattatgatcacctttaccctcccgcgcattatggcaggtgctcattggtttacagatattgctatcggttcattatccctgacattaattggaatgagctgggtattactgacacccttaagtgatattatggcaacatggctggataaaaaactgccgtatattaggcgtactaattaaaatagtaatggtgaggagatattgcttatctcctcaaaactacacaatttttaccaaacaggtataaaatagcaacaatcattctaaccccttagttcctaatctaattttttgtaaagaacgctttttgtatctcgctttttactcatcatttctgtaaccttccctgtgccctattattaaaataacgcgttttgtaaagatattaataaaatgtgttgcttcgcacactttagggacagaaaatttgttaattcaccatcttctgactacgctttagaacgtttagtgtttccatgatggcgataagccacgttaagggctgcaagggaaaatcaatataatggtcaagtctcaaccaatactgagatacatattgcggttgatacccgcaattctcgcggcagtggtactaaccgcatgtagttcgccagactcccaaatgcgtagcaaaaaaactgatactcatgcagtaaacagccaaaagcacttcttactgcaagcgtctcaggatgagtttgaaactctagttaaaaatttggatactaaatccaaaatccttaaccaatatgcagactggaaaggtgttgcctatcggcttggtgggaatacaaagcgcggcattgattgctctgcttttgtccaacgtaccttccatgatcagttcgatatagatttaccgcgttctacatcagagcagcaaaaaattggccaaaccgtcagccgttctaaattacgggcaggtgatttagtgctgttcaaaacaggcatttatatgcgccatgtcggtatttacatcggcaataaccaatttgtacatgcttcgaccagtaatggagtgatcgtttccaaattgaccgatacctactggactaaacggtactacggcgcaagacgagttctgcgagacgtgaacaaagtctcctgactatagcttaattcccttgcagacataaaaaaacgcttccaaagggaagcgtttttttatccaattgttatccactaaagtgggtacaacgccgttatgttttctgcaatcgcagcacctaatgtcttaagtcgacatatcactgcactctcatcctctttagcaaaaaacaaacatggctcaccttcccactcaattactgcgctcaatatttgcatatcagcaatagattgattcaaactatgcaaaataacccgagcattttcaccttcatggcttaacaatttcagccccatcaggctatttcctatatctgtttcttctgttggtaaaatttcaactttcgtaccaacgaagccagatgaccaccgataactttgcggcagtctatgtactaccgaaagttggatattatccacgtattattcctatcagaaacaacattaatacatctaaccaccagctgtaggctatcagtgcgtcaaaaccgaataaccccccaacaaaaagcaaacaaaaaagtaaataaaaagttaaaataaaatccgatttatcacacacttttcatcttccattttaaaaagtgagatcaaactcgcattttgtatatatttatactgtttaggtaaaaaattcaacttatttttatgcaaataagcaacttttcattcaaatttcatttacatatttatgtgtattaagccatgccacgtactgtgaaaaataatatttttatattacaatcagttaattaacaacaaaaccattttaatctatagtcatgaactcaatggcataaagttaacaaaaaaccaacaacccaatattgattagcatcatcaaattaacaaatgtctacatttgtctgctgattaatcggtatatcctgtctatccaaaaaatcaatggcttcttttgctatttcaagatttttggggattatctctaaatgcagccactatcaggacagaataaaaaatattgggaaaactctatgatttttttaatgtggagataggcagtgcagcaagtgtaaggaagcaatatatgaattaaaaaaacagaggctaccttatgctatctgatagcccctctggttattttattttttggccttattcgcataaataataagtaacattgccaatattacgcataatgccattgagcccaccatcggccatgcgctttttgcagatactgaagataaaattgtgcccaccagcgcagcaatactgaaacgaatagttccagccagtgacgcaaccgttccagccatatgaggataatcgtccagaacaacagccatagcattagaagtgatcatggaaataccactgatataaattgcaacaccaagtacaagagaaataaaccctaaatcaagtacagtgctaaataataaccataaacccatgacaaattgcacaaacacgccgaaatgcagcattttcgatgcgccatatttgcggacacattgactattaatcatggtcataatgaacagaaaaataatgttcaacccaaaatagtaaccaaaatgttgtgcagaaaccccgttcaagtcaatgtaaacaaatgcaccggcactaagaaaagaaaacatgcctgcaaaagaaaatccacttgccaagatgtaaaacagcacctgacgctgccgaaataacatagcaaactggttaaaaatagtttttaaattgaatcgctgccttctctctttcggtaatgtttcccggataaagaaagcaacaagaaacgcggttatcactccagcaatcgagattgaccagaaaatagcatgccaattgaaccataccatcatcaacccacctaacatgggagccaacaacggcgcaatgatcatcaccaatgtcacaaaagacatactgcgggaaaattcatctttcgtgaacatatctcgcatcaaagcgttgatcacaacacttgctgctgcagcagaaaacccgtgcagaaagcgcatggaaataaaggtatcaatattttgtgacaaagcacacgcagcagaagcaatggcaaaaacaatcacaccacctacaatgactggcttacgtcccagactatctgacattggcccatagaccatctgcccaatggcaaaacccaaaatgtaactactcagcgtcatttgtactcgaccggcatcgacgccaaaattggtggcaatcgttggcatactcggcaaatacatatcaattgccaatggcatcaacatagaaagcaaaccaaggatcaaaactaaccccaaataggataatcgttgttgttgcacgctttaactcccgtaacaacttgttaaatagatggataaaagaaggttaaggtgttggcacctgtatgctgttaatttcgtttttggtcaatgctcgatattctcctggctccaatgcagagtccaaacaaatttgaccaattcgttcacgatgaagctcaacaacatgattgcccactgcggcgaacatccgttttacttgatggtatcgtccttcactgatactcaaacgtacacggtgaggctcgataatttctagtttcgctggttttgtcagtgttttttcgccattcaactgcacacctgcaagaaatttcatctcaatatcgtctgatattggatattccaatgtaacaagataggttttttcacaatgatgtttgggtgacgtaatacgatgtgaccattgcccatcatctgtcagcaaaaccaagcctgtggtatcaatatccaaacggcctgctgagtgtaatttatgggcaacaggttcatcgataaaatacaaaattgtcggatttgttggatcatccgtcgaacacacatatccctgtggtttattcagcataaaatagcgggaaccatctaactgttccaatactgaaccttcataggctacctgctgatcgggcttcaatttatacgcaccgctcttaatgacctcgccatcgacagtaacccgactagtccgtagttcacgacctatatcgttacgacttatacctaactgctgtgataaaaatttatccaatcgcatgaatagatgtacctgacagaaaataaacacatatgaacacacccttgatattgcaagcacttcaagggtcactattggagtacaagattaaacagataatattcagagtcatcgtaacatcaataattataacaataataaactacatgttatagccatcttactttagtaactgaatggaaagcgctttcccgacggcaagaccacaggaaaaatgttatcctctctatcaactatcttttatctaatacccatgacagtaacataaaaatggcttttactttacgcccttaccaacaagaagcggtagatgctaccatccaccattttcgtcagcacaaagatcctgcggtcattgttttgccaacaggggcgggtaaaagcctcatcatcgcagaattagcaaaactggctcacggccgagttttgatactggcacacgtcaaagaacttgttgcacaaaaccatagcaagtattgtgcctatgacctgcaagcggatattttttctgcgggattgcatcaaaagcagagtgaaagaaaagttgtctttggtagcattcaatccgttgctcgcaatctggattgttttgatcatcatttctcactgttaattattgatgaatgccaccgtatcagtgatgatgaaaacagtcagtatcagcaaattatccagcaactcaagaaaaacaatccccagatacgtatcttgggcttaaccgccacgccctaccgtttaggctctggctggatataccaatatcactatcatggcatgatacgtggagatgaacactgtttttttcgtgattgtatttatgaacttccgttacgttatatgattaaacatcactttctggtgcccccagaaagattggatatgcccgtaatgcaatatgatttcagtcaggttcgtaccagccagcagggaattttcaatgaagctgacctgaatcgggagataaaacgacaaaagcgcattactcctcatatcattaagcaaatcatcgaatatgcccaagaccgcaaaggagtcatgattttcgctgccacagtggaacatgctaaagagattttccaattgctatctgctgaacaggccgcattagtcagcgcaaataccccagcaactgaacgggatttattgatcactgctttcaaggcgcaacaactccaatatatggtcaacgtcgccgtgctgacaacagggtttgatgcgcctcatgtcgatttaatcgctatattacgtccaacagagtccgtcagtctctaccaacaaatcatcgggcggggattacgcttatcccctgacaaaaaagagtgcttaattctggattacgccggaaatccccatgatatttattcccccgaagtcggtagtagcaagcccaattctcaaaaccagcctatacaggtattttgccctatctgccaatttgccaataccttctgggggaaatgtacagcggaaggtgaaatcattgagcattttggccgtcgttgccaaggatgggaagaagatgaaagcggcaaacgacatcaatgtgatttccgatttcgtttcaaatcctgcccacattgcggtgcagaaaatgatatcgctgcacgacgctgtcaccgctgccaggaagtcctggtcgatcctgatgatatgctgaaagccgcccttaagctcaagaatgcactggtactacgttgtggcggtatgcaattaacgtcgggtcatgatagtaaaggggaatggctgcaaatcacttattacgatgaagatggtgcggacgtatcagaacggttccgtttagcaacacctgctcagagaaaagtgtttgagcttcacttcctacgccagcaccagcgtgcgccgggtatccctctgcaatggaaaacagctgaggacattgcacaacagcttcctctattacgacatcccgactttgttgtcgcacgaaaaaaaggtcagttctggcaaattcgggaaaaggtttttgactatcaaggacggtttcgccgagcagatgatctgtactgagccgattaaatcagcccaaaagtactttctatttgctgtcatataggtttttcgttaaaatgccgcccgcttagtgtagtacattatattaagccaagtctcgaacctgctgctgggtcgcctgtagcaggatttattttcttcttttacagagaaaaaataatgttaactattaatgcagaagtacgtaaagagcagggcaagggtgcgagccgccgcctgcgtagagctaacaagtttccagctatcatctatggtggtaaccaagaaccagtttctatcgaactggatcacgatgcagttatcaaccacgaaagtaaaccagaattctatgaagtcctgaatctggttgttgatggtaaagaaactacagttaaagtgcaggcagtacagcgtcatccgtttaaacctaagctgacgcacatcgatttcctgcgtgcttaattagccacaatcgagcttttatcgggacgccgagtagataacgccgcatttgcggcgttatttatttctactattttattcttactgctgataggcgttaatgattaccactgccacgacgttgcagttggtcacgcaagtttggtggcgtgcctttaatcgtcagagtatccgtcactgggtcccaaaaaattcgctctcccaacaacattgcatcaaagttgatggtcaatccgccaccactgccagcaaattttgttaattgacgtaatgtaccgcgatctgctgggaaactctcttccaattcgtatccctgttcctgcgaaaattgctggaattctgctcgcccaatggtggcaattcttgagacaactcttgtagtttaatctcctcacctgcctgtaactgctcattacaatagctgtaaacctgctggcgataagcctgacgttcatttttatcaatctgggctgattcgcaataatcgtccaccgcctgcaacaaccccttattctgcactttggcattcatgccttcactggcagacagaaaatccataaaaaagtcagaaaccttacgccctacccgccctttcaaaaaagtcagataacgactggattcgggattagtttcccactcagtcaagtcaattctcgcaacgatatcagcatgaggaatatcaagatactgcgtagtgttcacatccagctcgtcattgacagacatgctgttgcaactattgagaaccgaaataagtaaatactctacggccagataccgatactggcaaaacaacaccgtaccaccttccgcaaacggatattttgtcaattcatctttcaagcgaacggttgcagcacggctaaaaccgagaaagtcttcatctcccttacgttgatgacggagcgattccgccagttcactttcatcattgaataaaccataggctttgctttttgcgctatacacacgatgtaattcagccatcatatcttctacgacctgattggtggtcagcaaagaatcacgcagaatgacttcaagtgtttgttcatcacgtttaatcaaccggtgtaacgcgatctgggtaatttccagactcattatttatactccttttgcagctttgaccgttgagccttgcggttagcggttagcggcgtattcaaacaccgttacctttctgatgcaacagacttcagaatggcagcaactcacacagtcggaaaattaatttgtcataaaaaagcagaaaattgcccttctatacggtagtatatagggctttgtatatccaggatctttgatttatgccacagtcgtctcgctacagcgatgaaaaagttgaacatttattagctgaattggtaaatgttttcgagaaaaaccatacacctactgatttgtccctgatgatcttgggcaatatggtaacgaatttaatcaatacgagtattgcccctgcgcagcgtaggcacatcgcagactcgtttgcacgcgcgttacagtcctcgattaatgaagacaaagcgcattaatttttcattaaaaccttaacgtaaaaaatatggtgactagccgtcagcattaccgcgaaaaagtctctcagatgatcagctggggacactggtttgcactgttcaatattgtgttcagtcttgtgctgggcagtcgctatttatttgcgtctgactggccgggttcactgtttggtcgcatctatgcgctactcagttggctcggtcattttagtttcattgtctttgccatttacttacttattttatttccgctgacgtttgttgtgatgtcacagcggttattgaggtttctttccgctgcactggccacagcagggctaaccctgctcatactagattcctctatctatattcgctttcacctgcacctgacaccgttggtttgggacttagtcaccaacccagaacagggcgaactgacaagggaatggcaactgatgttcatctgcataccggctatttttctagtgcagatgctatttggcacatggagctggcaaaaattacgtagcctgaatcgccaacggtcggtaagccattggcggcggtattcattaccggcttttatcgcttcccatctgatgtatatctgggcagatgctaacttctaccgcctcatttacatgcagcgttcaaatttaccactggttttattcaatgaccggacgcaaattccctggaaaacaccgaattactggatcaacaggaatccagcgccgtatgaaccaacaaggaaacccggctgccctaaccgttgaatatccactgaatggcttatcctaccaagataacaggcaaggttataatttactgttgctagttgtagatgatctggataacaaagacattaccaacgccatgccgtcccttgagcgctttactcagaacaatatccaatttacacagcacttcagtactggcattcaaaacgatactgcattgtttggattattctatggcatatcatcaggctatctagatggcattcttaatagtagaaaatcctcagcgcttcttgatgcactgactcaccagaggtatcaatttggtctgttctcttcggatgggttccaaacacctctttaccgccaggctcttttgaccgattactcattccctaccccaaccaagaaagatgatagcctaaccgtgacaaaatggcgtcagtggctggatctcaatcatggcactaccccgtggttctcatttttgggcattaatggttttacacactcaacgggccaatttgacaaaaaagcacttgataccgaaatcaataatgttttagagacactaaccaataaaggcatgctggataaaaccatcgtggttattacagccaaacacagtgaattatccacgggacactcaccaaaatggcttactggcgacaaattcaatcgtgaacagatacatgtcccgctcatcattcactggccgggtacacctgcacaggtcatcaacaaattaaccagtcatcaggatgtcatgactaccctgatgcaacgtttattacatgtcagtaattctccaggtgattattctcaaggtgaagatctctttaccgttcggagagataacccatggttaatcacgggtgatgacggctcattaattgtcacaacggctacaaataccatctatctttccaagaacggagaatattatctgtatgatttggatggtaatgaaattcaaggagccaagcctaacctcgcccagttattacaaatactaaccgaggttaaacgatttttagcaaactaatcgtcgaaaaatcaagcactcactaaattgagggcttgctttgaaaataaaaaacggtagtatagtaaaagtcatcggcatgtagcgcagcttggtagcgcaccgtcatggggtgtcgggggtcgtaggttcaaatcctatcatgccgaccaaatttccctaagaaaaccaacctattatggttggtttttttatgcctcaaatttgcttggtgtaaaatgggtgtaaaatcccgccctaatatctccattcttaccttaccttaccttatcttcacttgtactttctttgttaatgcgacagaacccttttgcgcataggaaaaaataatcaataaaaagccccgcaatgaactgaccccataaagttggacggttttagttaggtagatataagccagatcccatgtcagagggctatccttgaatcagatgattgttcctgaacaaacttgatacgaatgtactcagaatcgccgactagctcatacaattcagacgctatttcccaaacttgttctgttaactcatcataagtcttagcttctgtaaccagcccaagttcatcgcactcagaaacccacacatcaccatcatggataacattcacaacaaaaaaatcattaagccggtctaatcttttactaactgaattaagcatctcaaagatcgttataccgaaatgctcatgagcctggtaagaagcatcagaaaaccatctaaaaagagcattaaccctgcgtcctagcgctatcaattcatcatttctagactcattgaaatcagacataatatgaagtagatggctaatagtataaaaatgtacaactggcccgatactactttcacccaacatggctgattttctatcttgaacatcccccatcccttttaaccaatcgtccactaaaccattaacttcgagctttacataatcagtggcgcactcacgaaagctttcgacaatatcagtacgtgacacataaagttccattttaatcacaacaaacctgaccgtcttatcaccgaattttgcgctatagataacgcgatccatttattcctcctttagtgctttctgataagtatcatatatcagcaatggagtccaaaaaaacactatacgctcatttttaatacaagccatccctaacaataataagcgttactgattatttgatcagcatattccaaaagtgtgaggggttttacacgtttttttgtaactcttttgccccctatttttgaatagggtatatgttaaaaaatgctcaaaaaacaaaaaagaggtaatttacctgagttctggataaaaaattgaactaagtgcctgttccaagatcagaattttcgaccagaaaacgatctcacaaggaacagtcatggataaatgaattgaacttttctgcgatgtcgacgattcttgccgtgttttcattccaccaggggaacaacagtgtatcgcgaagtggcaacgccgacgttatggtcacatgagtatcagtgaaatcatgaccatcttgatcttttttcctatgtcaaatcaccgtaatttcaaaatattttatttgggactcacttggcaatatcattacaacgattttccggccttgctcagttacacctgttttatcggagttgtttcctctgtattacccttgctacttgcagtacggctttaagactcaacaaccaccaactaaagtcggtggttgttgagtttctgccagttgacctaccaacagatggcaaccatcagacaattttcttttaacgttcagtggcgtattaagcattcttgagtacctctgcaatcgtgattggctcctgcttgcgctctttggttaattgatgcagtgggttcagttcaccaatagcttctaatagcattaaaaactgccgcaaagagatattgcctgtacgctcaaatttcctgatggtgctatatggcacaccggaacgcttggacagcacttcaacggtgattttttgttgcttacgttgtcgcttgataaaatctcttaattcatgctgtacatcataggctgtgtagagtgaaagcatggggatgttctctattactagagtaacaataacatagtgaaaattatgattaaattccacaatagtagaattattgtggaatgtgtgagttgtttcttggtgagcattccgtagtcgttggagctttttttacttatataatggtgggcgcattgagaggatacatttgagctatttaccattggacaaagatattcacccaggccatccgcttgagcaggtggccttgttgttttgtataatcacaggcatgccataatatgtgcggattcacgcaaatcgctaaattggcctttaaacgagcctcacggatgattttatacacctgctgacatgacatgcgtgtacgtgtctttccagttcaaccaacaacaggttcagatgattaagaaaaataaaaataagtaatttatatgagttttgttgattatttttagactgcaatatcaacgatagaaaagaataatgattttattggaaataaaactcacgaaaataaagggaacttaaccaggggttacgcatgaaatagtgcttccatataaccgttatcccatcccgctgattttcttcgcgcactcaaactcaatttactattgatatctcgtttaacaatattgagtgccattttacgtaattgggcaaatattcttgtggcgacccgctctctcatccgtgaatcatcttctcggaaagtgacatccagtacccagtgtaaactattttcgatagcccaatgttttcgtattgcacctaactgaaaggcgggagaatcatgacaactgcttaaataataacgaaagtcagaagtcaccgtgtcagaatagtgttcttgtcgtatcgtttctgttaccagaagagcttgaatatctggccaagaccttaagtgttttgtttctgatgtcagtggcagaacccatccgcgccgtctgacggtacgtccgtggctatcatcgaattcatcatggtcaggtttaaggtaaggtttttgggttatctgttgttgttgaaaatagttaaccgcttccgaaaaggttttcccctgattgcctttaagcgacaaaatataatcggcttcactctcgcgtagttgctgagcaatcgtgcgttggcaacccatcgcatccatcgtcacgagatggcctttcaatgaaagcatcgataataatgccggaatggccttaatttcgtttgattttccgtctacggcacattgacataagctaagccctttctcaaccgtgaatgcactcaccatatgtaatgcgctttggtcaattttcttatcaaacgaatgacgtaaacttttaccatcaatcgcaatgatagcccgtttttctgaagagaggtcacgagaaacccattgataaaaatgatgttcaaagaggctcgggtttaataaactgaaacagcgccggaaagtatcatgtgacggaataccccctttgagcggaagaaatgaactcagccaatcctttttgagttgaccgtactgttcaatatcagtccaggcgttagccccagcaatgacagcgcataccgcgatcactaagatatcaataacacggtgtttgacctttccctgacaacgtgggtctggaaaatcagaaaagacatccactaattctttcattagcgtccctctaaaaatgaaagaattatccactaaatattttcatgcgtaacccctgggaacttaacaatcctgtaataaaatgggggtaattgacttgattttaggctgtaccattttgttaagtttatataaagaaaaaacaccttaataaaaataggaactaaagtgatagtttctccgacaaacatactatgagtgatttttgccagaatatttcatcaattaatcaatgagaatatccgtgtaacaggagcttatccagccgatcgaggccaatggttttgttctcactcaaccccttggctgccatatcagcgaagtttactagaaaaagatccatagggagcgaagctgcgatttgacgacatccggcacataaaccttttttgtagattttctgtcctgggactttcgcttcgctctttcttgatgagatgctatttactcacggtttattttcccctaacccacggccgggcagagtttggcatgctataccattcgaaggaggagccactactgggtatttatcatctggagtgatataaacctgcgttgttgccacatatccatcatgaaaggttgcttctatataagtagcttcccaaccgggcgctttataactcaatgggatcttaacgctttcccctgtgctaatttcgagtgatgaagaagtatatctgataccacatacgtaacgaaaatctcttgcagctagatttatagccgtccaacgagtaactttcacaggtttttctgaaaaattcacggtgagtgtgcgttccgttttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaagtaacttgtcgataccttgttgataatagggggaaaaggtaatcggccagtttccaccgtaagtacgatacatattctcaagagccaagtcggtactaagtaagtccataacaaagggcacaatagcatcaacgtcaggatctgaaatagaagataaccaagctgtccatccgcgctttgatgctccagtgacgataaatttattaatattccattctttcagttcctgttttgccaccctcatagcctgagatacagtaacagccataggaatatgtaacggaattaattttctctgttccggcccatccataaacaatgcccagctacgcgcaacgctgtcatcttctttgagtggtttattattctcgtatgtaatgtactgattcggaatattactgacagaaataactaccgtattcgtggatcatgcaatctctgccagtgatttctcgctgaaatttgttggctggcttgtttttttgatgtcatcatcataatttgttccattatttaccacgacgagcgcatgttgcgatttagggttatccgggatatacatgtcaacgtcatgttgccagctatcaggggataccaaatttcccggcgaccatcgttgtgatgtcatttcatattttagcaattcaatactaggtagtgattttttgccttggagcgaatatttaaccgggagcgcagccagtttcgcccggtaacacggaataacatgagaaaaatcaaccatatcctcttactggcatatggcattttccgtatttatcagagcggaaccttcagcagaaaagaaaaaaagagtgataaatagcttacttagtttcatcattcatccttaatattgaacaagtgatacacattgacgatttcttattgctgcataatagaaaccattctgatgctactaccgtaataaatgctatttcatgataccttcctcatgtctcaaaaaaaaagacccagccaaaaatagctgagtcttcagtgaagttttattaagattatgccctacatggcgcttttcgcctgctgaacgatatcaatcactggttgtggccaaataccgaggatcaacaccagcaacccagagatcaacacaacgatcccacctgaagtcaacgcccagttgcttggcgtatcgcgattcagtgtcttcggtgcaggcagatacagactaaccattactcgcaggtagtagtagaggccaatggcactgcccagcacgacagcccccgtcagccaccacaattctgcttctaccgccgtagcgataacatagaatttaccgataaacccgaatgttaacggtatccctgccagggacagcattatgatagtcatgactgctgacagaatcggtttatgccagaacaggccacggtatgagtacagtgagtcagcatctggaccttggtatggactggacatcagactgactaccccaaatgcaccgatgctggcaaacaggtaacccgccagataaatacccgccgtttcttctgccaatgtgtgacttcgaatggcaaccaagaccaccagcaagtaacccaagtgcgcaatcgatgagtaaccgagcaggcgcttgatattactttgtgtcagtgccagcaaattaccaaacaggatggaagcaattgccatcacggtcagcacaatgcgcagcgtttcactttcagccacaggtgcttcgaggaataaacgcattatcaccgcaaagatagcgactttgctggccgtcgccagaaaagtcgatacaggtgccggggcgccttgataaacgtctggtgtccaaagttggaaaggtacgagggaaagtttgaaacccagccccacaagcatcattcccagccctgccaagatcagcggctcatgcagttgactgtcactcaggcttctacccagtgacgcaaaggacaagtcacctgattctgcgtacaacagtgcaataccgaatagcaggaacgaagatgccgctgcggacagcagcatatatttaatactcgcttccagtgaacgtttctggcggtacgcataaccaatcaagccaaataatggcagagtaatcagttcaataccgataaacagtgatgccatatggttagcagaagaaagcagaattcctccgacagccgcaatcaacaccagcaggtaaaattcttctttgttatcgggataattctccagccatgagtaagcaaatgtggtcgttgcaaggctcgcaatcagcacaaggccggtataaaacattgcaaatctatccacatgaatcagtggcgtgacatccatcggctcctgctgtccaacaaaatagagagaaagcagggctagattcagaccaattaccgttaaggtgaaattgatcaaatgatcgcgtcgccacgcaatggacagcatcacaaccaccaccgtcaatccgacgatcaatagcggcaacagtgcgatcaattgttcagaagttattgtcatggcgagttacggccttgtagttaaaagtgaagctgaataccaattttggatgttactcatcgccgccgctgaggtatcaaggaccggttgcggataaacacccacaatcaccagcaagacgaccaacagtagcaaaatggagatttcacgcacatccatccgttgtagtggcttatcagttgttggcgtgccgtaatacgctttctgcattaaatacagtgcgtaaacggatgcaaaaactaaaccaaacacggatacggtagtaataagggtgaatttgctgaaactgccgaacaggatcatgaattcaccaacaaagttaccggttcccggcatacccagtgtcgccacagcgaaaaacagcgatatcgcaggcaacagttgaattcttccccacaaaccgcccatattacgcatatcgcgggtatgcagacgttcatataattgcccacacacgataaacaggccagcggctgacaaaccatgtgcaatcatctggatgaccgccccctgataagccagttggctgccggtgtagatggcaatcagtacgaaacccatgtgagaaacactggtataggcaatcaggcgtttgatgtcagtctggctgaaggccatccacgcaccgtagaagataccaatgacacccagccacatcgcaatcggcgcaaattccgcagaggcttgtggaaacagaggcaagctaaaacgcaacagaccatacgccgctgttttcaacaagatccccgcaaggtcaactgaacctgcagtcggtgcctggctatgcgcatccggcaaccagccatgcagaggcacaacgggcatttttacggcaaatgcgatgaagaaacccagcatcagtaagtattgaacggtatctgacatcggtgtattcagcagtttttcatagctgaatgaccattctcccgttgcatcgtaatagacgaaagctaatgccagaatcgaaatcagcattaccagaccactggcttgggtataaatgaagaatttcgtcgctgccgtaatacgggttttaccgcctgaacctctgtgtccccacagagcgatcaggaaatacatcggcaccagcatcatttcccagaagaaaaagaacaggaacaggtcgatggcaaggaagacacccatcacaccgccaagtatccacagcaggttcagatggaagaatccctgatatggctggttttcattccacgaacagagaattgccatcaagcccagcagtgctgtcaagaccaccatcagcagtgataaaccatccaaagccagatgaatggagatgccaaagcgaggtatccacgggatcaggaattctgattgccactgtggaatgccctgtgggttggtcagcgtataaccgccctgtaaccaaagttgcagggaaagcagcagagtcagccccatcgccagaagcgctatccaacgcggcatacgggtgccgaagcgctccgtctgccagcacagcaagccaccgatgaagggtagaagaattagccaaggtagtagcatggcgcaatgtgtcccttaattaaatcaaaagcagcagagccaaaaccagcactgcccccaaccccaaagaggtagcgtaccaacggacttgtccgttctcacttaagccaagccccttattaccccaacgtgacaatatggcaggaatattcatcagtgagttcaaaggatcattctgtaatagttgagtaatgcctttgaatggtttcacgaatacccagtcatacagtgcatcaaatccccatgcatggaaccaccatgtggagaagaaacgccccggcacactgtttgcagtggccttaaccacagcacgtttgcccaagtacaacgctgctgccagcaagataccgagaacagcaaccacaccagaaacaatctctaatgtcagtttgtcgtcatgccctgctgttgtactactttccggcagaactcccgccaacggtggcacaatcagcgctcctacaaaagtagagagcaccagcaataccgatagaggtaaggtatgggtaatccctttgactggatgagccttggtattttcttcaccgtgaaacacgataaagatcattcggaaggtatacagtgatgtcatcaaagcaccgacaagccccgccagcatcaggttcatatgaccattcgccagtgcgccccacagaatttcatctttactgtagaagccagcagtcagaagtggcagcgctgacagtgccgaaccacccacgatgaagcagagataaacaaacggaatgcgcttactcaagccacccattttgaagatattctgttcgtggtgacaagccagaatcacggagccagaagcaaggaataacagtgctttgaagaatgcatgagtcatcaggtggaagatggcggcatcccacgcctgaacgcccagagccagaaacatataaccaatctgactcatggtggaataggccagcacgcgtttgatatcggtctgcaccagcgctgcgaagcctgccagcagcaaggtaatagccccaatagtaccaaccagatgaagaatatccggcgccatcaggaacaacgcatggctgcgtgcaatcaggtaaaccccggcagtaaccatagtggccgcgtggatcaaagcagaaaccggtgtcggacctgccatcgcatctgccagccacgtttgcagtggcaactgagccgatttacccacggcaccacccagaatcatcaaggttgcccaagtaatcgccgtagagcctgcttcgatatgctgcggtgccaataccgccaattcgcggaaactcaatgtgccaaactggtcataaaggataaacatcccaatggcaaggaacacgtcacctacgcgggttacgatgaaggctttcattgccgctgcgccattggcaggcgttttatagtagaaaccgatcagcagataactacacagcccaacgccttcccaaccgaggtacatcagcagcatgttatccgccagtaccaaaaccaccatactggcgataaacaaattggtataagcgaagaaacgggagtaaccctcttcaccgcgcatgtaccatgaagcataaatgtggatcaggaaaccaacgcccgtcacaacactcagcatggtcagagatagcccatccagtaccagattaaccggaatactgaagttatctgcctccatccagttccacaatgtctggctgtaaaccagcccctctgccccattctgggcgtggaaatccaccccggcccagagtgtggctaatgctgccagcccaacagaagcactcccaatggtagctgacagattttcagaccagcggccacgagagaatgccaatagtaaaaaacccagcagtggcagtagaattgttaaatagagtaggttcatccgcgcatctcactgactatatcaatattcagactctggcgacgacggtacaactgtagtaacagtgccagacctatactcgcctcggcggctgccagagtaatggccagaatgtacatcacctgaccatcaggctggagccaatagctgccggcaacaacaaacgccagtgccgaagcattgatcatgatttccagcccgatcagcataaataacagattgcggcggacaatcaggcaaacaaagcccaatacaaacaaaatagccgccagaatcagaccatgttctaaaggtatcattattgatcctccgtacgattactgatcacttcaccctgacgattttcacggccaatgtgataagccactaccagccctgccagcagtaacagtgatgccagttctactgccaggacataaggcccgaacaggctaatgcccacttctttggcactgaccacttcaccgctgatctcagccgttggcaggctgctgatagcaaagatcaacacaatcagcagcacagtagccagaatagccgggccgatccaaacgcggagctgcaaccatgcccgctcttgctcgacaacagatttaccgaggttgagcatcatcacgacgaagacaaacaacaccatgatcgcacccgcgtaaacgataatttccagtgcaccggcaaaatatgcgcccagtgaaaagaacacgaccgacagtgccaacagagaagtaatcaggtacagcaacgcatgtactgggttagtgtgcgttatcaccctgagtgtagcgaggatggcaaccagccctgcgacataaaatgtaaattccatgaatatcgctccttacggcaacaggcttttaacatcgataggtttagcttcattgtcggcttcccctttatctttgccatcaatcgccatgcctgtcttatggtaaaagttataatcaggatatttacccggtcctgaaatcagcagatcttctttttcatatacgagatcttgacgcttgaattcgcccagttcgaaatccggtgtcaactggatagcggtcgttgggcaagcctcttcacacagtccgcagaaaatgcagcgcgaaaagttgatacggaaaaattcaggataccatcggccatctttatgttcggctttttgcagtgagatacatcctactggacacaccgccgcacacaagttacaggcgacacaacgctcttcaccgtcaggatcacgcgtcagaacgatgcgcccacggtaacggggtggcaaataaaccggctcttccggatacatttttgtttcgcgtttatggaaggcatgaagccctatcatccaaatactgcgtacctgggtggcgaaaccaaccactaactctttcaatgtcatggttcaattccccctttattgagcgttgtataaaattactgcggcagtcgccagcaagttgagtaaagttaacggtaggcagactttccagccaaatgacatcacttggtcataacgcggacgcggcaatgcggcacggatcagaatgaacatcaccatgaaaaatgccgtttttaacgcaaaccagatgaaagaaggcaataaaggcccatgccagccaccaaagaacaatgtgacgattaaagcagataccgtcacgataccgatatattccccgacaaagaacaaaccgaatttcatgccggaatattcgacgtgataaccatccgccaattcctgctctgcttccggctggtcaaaagggtgacggtgacacaccgccacaccagcaatagcaaaggtcaggaaaccaaagaactggggaatgacattccacatatgttgttgtgaattgacgatatccaccatgttgaaggagccagcctgtgctacgacgcccatcagagcaagaccaaggaaaacttcatagctcagtgtctgtgccgatgcacgcattgcccccaacagggaatatttattgttgctcgaccaaccggcaaacagcacagcgtaaaccgacaaacctgccatcatcataaagaacagaatgccgatgttcagatccgccaccatccacgtggggctgactggcacgatagcaaacgccagcagtaacgagcagaaagcaatgattggagccagagtgaaaatagcccgatcggagaaacgcggtacccagtcctctttaaaaaacattttgagcatgtcagcgacgagctgcaatgaaccgccccaacccacacggtttggcccgtagcggttctggaacagcccaagcaggcggcgttcgccgaaactcatgaacgccccgcaaacaacaacaaccagcagaatgacaaccgctttcagaatagtaatcaagacttcaatcacatcgggagtaaaccaactcattgtgcaatcccccgtaagttattggctgatttacccgccagaacaggtggaatacccggcattcccagcggcaggccaatctgaccctgcaccagattgccgcttaagcgcacagccagccgcaattgttgacccgcacagtcaaattccatcatggaaccttctttcacattcagatgttcagcatcctgatgattcatcatcacatacggctcaggcatacgttcctgtattacttctgcacgctgtgacaattcttcactgccgaacaggtggaaataaggcgcgacataccattggtttttctgtgcagcaaatgcagccggaatgctgtcaaagtagttcaaccccccatcggtcgtttcaatcaaacgcataccaggatcaccgaaacgcagtttgccaccgacttccgcctggaatttgttccatgcctgcggggagttccagccgggcgcccatgcaaatgggatttgctgacgttcggcaaacggactgttgttcccttccattgagaaagcaaatgccgtgtcgatatcctgcggttggcgctgctcatggacactgacattggccagcattgccgtacggccactgtaacgatgaggtgaacgagccaatttctgaccacggatacggaatgtggaatccggagcggcattgacgatacctttgaattgaggcatagctttgacacaagcttcaatcacatggtcaagttgcgcccagtcagtctggcattgtgcgtaagtggtatacagggaatgcatccagcgccagctttccagcataacgatagatttgtcatagaatgacggttcataaacctgaaaatagcgctgggcacggccttcctgattcaccagcgtaccgtcactttcggcaaagctggcagctgacagaatcaagtgagccttatccatgatagcagtacgttgatgatcaacgacgatcagatttttcaggctgcctaatgcactgtcaatcttatcggctgccgcatgacgatagagatcgttttccaccacaatcgcggtatcagaatcgcctttggcaatacgctgcaaagcgacatccaacggctgtgcttccatcatcgccagaccgaggctattagcataagccgcaacaaaggaaagcccaacatttgcgcctttgtctttcagtgcccatgcgatattggccgccgcctgaatcaatgcatcactaccagcattgctgccactgataatcaatggttttttcgcatcacgcagtgcctgtgcaacaatttctaccttcgttttcagctcatccggcagatcattgacggcgggtgcgatgctgttcagggcatgcgccacagcaaaaccaaatcgggcttgatcatcagttggtgcacggtaattccatgctgcaatatcatccagtcgggtatcatcaacgctggttaaaaacaaaggatatttggtgtgctgaccgatattcatcactgcggcaatctgccaatcagccactttctgagccgcagccatttcacgcgccttgcccttgaccgcctggcgtacagacagtgccatgcgagcccccgtttgggtcagatcttcacccaaaatcagcactgcatcgtaaccttcgatctcacgcagggatggagtatagacgccgccttgctgaagaatctccagcatcatatcgagtcggttctgttcttccactgatatgccgctatagaagttttctgcgccaaccagctcacgcagagcaaagttgctttcaatgctggcgcgtggcgaaccgataccaatagcatttttggcctgacgcaaaatatccgccccaccctgcataacctgctcggcattcagtgaaatccactgatcaccacgcaattgctgtggctgacgaggacgatcgtcacggttaacataaccgtagccaaaacgaccacggtcacacataaagtagtggttaacagtgccgttgtaacggttctcaatccggcgaacttcaccatgacgttcaccgggactggtgttacagccaatactacactgttggcagatgcttggtgcaaactgcatatcccatttacggttgtaacgctctgagtgggtcttgtcggtaaatacccctgtcgggcagatttcaacaaggttgccggaaaattcactttccagcgtaccactttcagtgcgaccaaaataaacgttgtcatgagcaccataaacgccaaagtccgttccgtccgcataatctttgtagtagcgaacgcaacggtaacaggcgatgcagcggttcatttcatgggcaacaaatggccccagttcctgattttggtgagtacgtttggtaaaacggtatttacggaatgaatgccccgtcatcaccgtcatatcctgcaagtgacagttacccccttcctcacagacagggcagtcatggggatggttggtcatcaaccattccacgacacttgcgcgaaattgcttcgcttcttcatcatcaatagagataaacgtgccttctgtcgctggtgtcatacaagacatcaccagacgaccacgcgtatcttctgcgttctgatattgcttcaccgcacactggcggcaagcgccaacgcttcccagcgctggatgccagcaaaaataaggtatatccagccccaatgagaggcaggcttgtaacaggttatcagccccgtttacatcatattctttgccgtctacatgtatcgtagccatagtcagcatgcttcccaatggcctgccgtggcaggcgttaatcaaaaattctgcttgagcgaaccgttcttgcaaacaagccttaccagcgctgcttgagcaggtttggctgaatgcccgcaatcagattggtgttgccgtagtctttggtgacaattcccgcttcaaattcatcacggaaatatttaatagcactctgcaaaggctccatagcgccaggcgcatgggcacagaaagttttgccggggccgaggaaacggcagagttgttccaaagtttcgatatcaccaggctgacctttcccatcctcaatggcgcggaggattttgacgctccacggcaaaccatcacggcatggcgtacaccagccacaggattcacgggcgaaaaactcttcaaggttacgggtcagggaaacgatgttgatctcatgatcaacggccattgcgagtgcagttcccaagcggctgcctgctttagcgatattttcaaaatccatcggcagatcaaggtgatccacagtcaggaaatcggttcccgctccgccgggctgccaagccttgaatttcagaccgtcacgcataccacccgcataatcttcgagaatttcacgggcagtggtgccaaaaggcagttcccaaacgcccggatttttgacccgaccggaaaagcccatcagtttggtgccggcatctttacttttgccttcgctcagaccgatgtaccactctttaccatgttcaaggatcgcagggacgttacacaaggtttcaacattgtttacacaagttggtttaccccatacgccggacgtagccggaaatggcggttttgaacggggattcgcccgacgtccttcaagggagttaatcaacgcggtttcttcaccacagatataacgccctgcgccggtatgaacaaacagttcaaaatcaaaaccactaccaagaatatttttaccgagcaaaccggccgctttagcttcttcaattgctctgcgcagatgtaccgccgcctcgacatattcgccacgcaggaagatgtagccgcggtaggctttcaacgcaaatgcgctgatcagcatcccttccaccagcagatgaggcagctgctccatcagcaggcggtctttgtaggttcccggctccatttcatccgcgttacacagcagataacgaatattcatgctttcatcttttggcatcaggctccacttcaagcccgtggagaagcctgcacctccacgccctttcaaaccagcatctttcaccaacgtggtaatttcatcaggaaccatgcccttcagtgctttttcagctcctttgtaaccactcttgctacggtattcatccagccagacaggttgttggtcatcacgcaaccgccatgtcaggggatgagtttccgctacgcggataatttctttcactcctgagtgcgttgtcatggatactgctccagtagtttttcaatttcttctggtttcacgtaactgtgagtgtcctcatcaatcatcatggtaggccccttgtcacagttccccagacagcaggttggcaacagtgtgaaacgcccatctgccgtagtttgccccggacgaatgttcaagtgcgtttctatcgctgcctgaacaccctgataacctgtgatgtgacacacaacgctatcgcaatagcgaataatgtggcgccctactggctggcggtaaatctggctgtaaaacgtcgccaccccttccacatcactggcgggaatacccaaaacttcagcaacggcatagatggcaccgtccggcacccaaccacgctgtttctgtacaattttcagtgcctcaattgacgcggcacgcggatcttcgtaatggtgtttttcctgctcgatggcatcacgttctgcggtactcagtacaaacgcaccctgtgtctgagcgtccgttacgttaatcacatcaagacgtacttgcttgtttgcgttaaattcactttgcatcgttagcgatccacatcagacataacaaaatcgatactgcccagataaacgatcaggtcagaaaccagactgccgcggatcaccgatgggatctgctgcaagtgagcaaaactcggtgtacggatgcgggtacggtaactcatggtgttaccatcactggtcaggtaataactgttgatacccttggttgcttcaatcatctggaatgattcattggcaggcataaccggaccccatgacacttgcaggaagtggttgatcatggtttcgatgtgttgcagggtacgctctctggggggtggcgtggtcagagggtgatcagccttgaacgggccttctggcatattcttgagacactgctcaaggatgcgcatgctctggcggatctcttccactttcagcataacacggtcgtaacagtcgccgttgtaacctgttggcacttcaaaatcgaagttttcatagccggaataaggacgccatttacgcacgtcaaagccgattccggttgcacgcagacctgcacctgtcacgccccagtccaatgcctgcttggagttataagaagctacgcccacagagcgccctttcagaacactgtttttcagtgccgctttaacataggagttcaaacgttttggcaaccagtcaagcaggtctcgcagcagtttatcccagccgcggggcaagtcatgggcaacaccaccaatacggaaccatgctggatgcatacggaatccggtaatcgcctcgacgacatcgtaaactttctgacggtctgtaaaggcaaagaacactggagacattgcaccaacgtcttgaatgaatgtactgatatagagcaggtgactgttaatgcggaatagctcagacagcatgacgcggatggttttcacgcgatcaggcacatcaattccagccagcttctcaacggccagcacgtacggcatttcgttgacacatcctcccaaatactcgacacgatcagtgtaagggatataactgtgccatgactgacgttcacccattttttccgcaccacggtggtggtagccaatatcgggaacacaatcaatgatttcttcgccatcaagctgaagaacaatgcggaatgcgccgtgagctgaaggatggttggggccgaggttgaggaacatgaaatcctcattttcggtaccgcgtttcataccccactcttctggtttgaaagtcagtgcttccatttccagatcttctttctgcttggtcaacatgaaagggtcaaattccgtagcgcgtgcgggatattccttgcgcagcggatgtccttcccatgtatccggcatcaggatgcgacgcaaattcggatgaccattgaatgtaatcccgaacatctcccacgtttcacgctcataccaattagcattagagtaaattgacgtgacggttgggacattcaagtctttttcattgagtgcgactttcagcatgatgtcacgattacgctcaatggaaatcaagtgataaaacaccgaaaagtctgccgcaggaagcccctgtcggtgagagcgctgacgctcatcgacaccatgcaggtcaaacagcatgacataaggtttgggcaattttttcagaaacgttattactgccagtaattgttctcgcctaacccagacaaccggcataccggtacgggtaggctggacggaaaaggcatctgggccaaattgacgattaagctcgcttacaaccggatcatcaaggtgatcccgtgtttcccaagcaggccgtgcgctttcttgcgcgatctgatctgtcatcattcttcaccacaacgcttgatcagggtttattgtgatcgcaacacattgctctggttacgtacgctatatggctaaaagccttaaatttcgtctggggtacgcaggtttttcactgcaatacgttcaccgcgcttccgttctctttctgattgcatattggcgcggtaaaccccctgatcgccgacaacccatgatagagggcggcgctctttgcctatggactcctgcaacagcagcagtgcctgcatataggcttcggggcggggaggacagcccgggatataaacatcaacagggataaatttatcgaccccttgaactacagaataaatatcgtacataccgccggagtttgcacaggcacccatggaaatgacccattttggctcaagcagctggtcatacagacgttgaataacaggagccattttgacgaagcaggttcctgaaatcaccatgaagtcggcctgacgtggagatgcccgcaatacttctgcgccgaaacgcgcaacatcgtgaacggcggtaaatgacgtcaccatttctacataacaacaggaaagtccgaagttataaggccacagggaattctttcttccccagttcaccatgtcatgcaaagcatgttccagtttgcccatatagacactgcggtgaacgtgctgctccaggggatcattgacaagttcctgtttttgcaggggataacggtcattctcaccgttcggatctatgcgggtgagcgtataatccatctttatgcctcgctattactgcatatgactgttgttggtatgaatgtcagcactgggtttactgacttgacgttgtgagcgcgcaggagtccagttcagtgctccaatgcgagccagataaaccaagcctgccaataacaccaaaatgaaaatacttgcttcggcaaaacccagccagccactttctttgatagaaactgaccatgcgtataagtaaagggcttcaacgtcgaagatgacaaagaacatggcgaccagataaaacttcgctgacaggcggagacgggcgctgccgacagaatcgatacccgattcataaggtatgtgtttcgctctgcctttcgacctgccccccaggaagtacgcacccaataacataagcgcacacagaccaaaagcacctagcaggaaaactgcaaacgcccagtgatgggcaaaaactccagtggatgtagacatactcgttgcttactcatcaaaagtggtgtcaagatgtctgctctttttgccggcagtgttgcaccacatcgattcatgggaagggataacaaccaaatatgaaacagtgctaatcaatatcattaatagcttgaatcgtcttggtttttattcctctaaacaatattttgcctgcatggcaaaagcgactacctatttatttacaaacaaaaaaccattaattaacagattgtgcttatatatcgctaaaacgtgtcagtcgagtaaaaagccaccaacgcgccataactagtttaaccgataactcgactttactacactattatctcaggaaaaacctgtctttccaccgcactaatcagagtatttttatgatcgagtgcacaatttcattgaaaaatattcaacacttgaatgtaattcattcaatccttaataaattatttctaaaaagggctgtagaaccgcaatctagcaactatttccaaaagcgaatttattttatcaatttagaaaaatgaaagttgttaacaaaacaacattcctttaactaaaattcgaaagagataggaaaattaatagggtatatttttggagggaaatatcagaaatggaaacgaaaacctgaaagaattattaataacagtttagaaaaaggctaatatctccacaaataaaatggaaatattagcctataaaacacgtaatacttactcgtctatattttcaacagtggatatttcaactgattcatcaatctcgtcggtttcaccagattcgacagtagttacggtataaggtgttttcttattttctatcgcatcaaaaacagtcaggacagattcattctgttcgttactgtttcgatacaagaagaattgtatttctggcaggcgtggcagcccttcactttcccccaaaattcttagatctgcattctgcatttccagagggcgggcagtaatgccaacttcagcattcacagctgcacgaacagctgatagggaagccgcttcataagcaatacgccatgaaataccggccgtatccagcgtatccagcgcgatctgacggaatgggttggtttcatccattacaaccaacggtatagcttcgttcgtctgcaactgaaaatcaggcgcacagtgccataacacaggcgaggagcgcagaaccgtttttggatggtgattaatttttgctgtggtcaatgccaaatcaatttcatggttatccagcatgctttcaataaactgagtgcgtttgattcgcacatcaacagccatgcgtggatagacagaagcaatgcgatttaacaggaaaggaagaagggtatcaacagtatcatcagatgcccctattcttaattcaccgtcagcatcattgtacgtcaatgatgcagtagcatcgtcattggcacgtaaaatctgacgtgcataaccaagaagttgaagcccatgttcagtcaggagcttgttacgtccgtggcgagcaaacaattctctccccacaagatgctccagacgttgcatttgctgactcacagccgattgcgttctacaaactgctgctgcggcggctgcaaaagtatttaagtcagcaacggcaacaaaagttcttagcagatcgagatcgaggtttattatctgacgatttgcatttatcattgtttattcatcactttttttttgattttaattactaactaacctggtgtttttacttcagcagtatcaaataaaataataccgattgtgacattactctactctattaaagagggcaaaggtttactgctttttttttactatctatataatcatgggttttaatttctcctttcttaacaaaatttatgcaatctccaaattaaagcggagataaaactctatttacatcacataatcaccaatttccagtacaaatatcctttttctgacttacctcaaagaatagcgtaactgaatgaagaaaatttatctcaacctaaaaatattaatattcttaatggtttaaccttttcattgaaaagtcctgaaaatgttacgggtaaaaattcaaaaacattgtcaaagtatcatgtgataaaaaccttaattaactttacgtcagtaaagataaattataagaatacattatacaaaccttcttacttttattgacaattcgagttccctttaatgttgtagactaaaaattcatcattaaattacctgttctttcattcagccaactaaaaacacgccattatttaaaatataaagccaagaataaataaaaatcaagaataaaacaccaataaaatacgattttttagagggcaaacttatacattagtctttaaaacaaccgttttcaccaaagatatcaaagcatcttcaaaatacagactgagaggagtacattgatcattacactttaatcaccacactttgtatgccgggtaaaacccacttcttgccacgaggttaaggcactctatgttttccattaataaatccagcaaattagataatgtctgctacgacatccggggtaataccctcaaagaagccaagcgacttgaagaagaaggcaataagatactgaaattaaatattggtaatccggcgccatttggcttcgaagcacccgatgaaattttggtcgatgttattcgcaatctttcaaccgctcagggctactctgattcgaaagggctgtactccgcgcgcaaagcgatcatgcagcattatcaagccagaaatatgctggatattaccgttgaagatatctttattggtaacggtgtttctgagcttatcgttcaatccatgcaagctctgctcaatactggggatgaaatgctggtgcctgcgccggattatcctctctggacagcagcggtatcactttccagcggcaaggctgttcattacctatgtgatgaacaacaaggctggttccctgatttagatgacattcgcagtaaaatcaccccacgcacccgggggattgtcattattaacccgaacaacccaacgggagcggtatatagcaaagagttgctactggaaatcgtggaaattgcccgtcagcataatttgactattttcgccgatgagatttacgacaaaattctgtacgatgatgcccagcaccattccatcgcggcactggcccccgatctctttaccgttacctttaatggcttgtcaaaaacctatcgcgttgcgggtttccgtcaaggctggatggtactgaatggcccgaaaaaacaggcaaaaggctatattgaagggctggaaatgctggcatccatgcgtctttgcgccaacgtcccaatgcagcacgccattcaaacagctttggggggctatcagagcatcagcgaatttatttttccgggcggtcgcctctatgaacaacgtaatcacgcatgggaattgattaatcagatccccggtgtttcctgcgtgaaacccatgggcgccctgtatatgttcccgaaaatagacaccaaacgtttcaacatccatgacgatcagaaaatggtgctggatctgttattacaggaaaaagtgctattggttcaaggtacggcgttcaattggccagaacctgaccatttccgtattgtcacactgccacatactactgatttgcaaatagcgattgagaaacttgcccgctttatcggcaattatcggcaataagcataaccatcctgcgtgaatattagagcctaaacagctctaatatctctatgccacacatatcccccacattctcattcagtacagattccaattgcctttcacaacttattttggctcctaatgggtttacttccaccctggctccgtccacaattaatcacattgtcccgcagcaagagaaaattatgagtcattttttcgcccagttatctcgcctgaagttgatcaatcgctggcctctcatgcgaaatgtgcgtacagaaaatgtttcagagcacagtttgcaagtcgcttttgtcgcccacgcactggcggtgatcaaaaaccgtaaattcaacggcagtatcaatgccgaacggatcgccctgctggccatgtaccatgatgccagcgaagtcatcaccggagatctgcctactccaattaaatattacaatccccaaattgcccacgaatacaaaaaaatagaaaaaatcgcccaacataaattattggctatgctgccttctgaattacaggatgattttcgctctattttggatgataagcttcacactgatgaagaaactgccattgtcaaacaggccgatgcgttatgtgcttatttgaaatgtctggaggagctatcggctggcaacgctgaattcaatcaggccaaatcacgattggaaaaaacattggccgaacgccacagtgaagagatggattattttctgacagtgtttgtgccaagtttcagtctttcccttgatgaaatcagcctgtaaccacagtgcagcttccttgatgcggaagctgcactatttaaacttagccaactgaaatccctgaaacagtcgattgggaaaaagatcagaatggaaaaagtatcgggatcatcgccacactgatccccatgacgatcagtgtaaaaggtacgccaagtttcaggaaatcagcaaatcgatatccaccaggccccagtatcagcgtattaacgggagatgaaacaggtgtcataaacgcagccgaagccgcaacaccaataatcatcgcaaagggcaaggatgaaacagacatctgtttcgccgcagcaatagcaatcggcgccatcaatacggcagttgctgtattggagataaacaacccgatcagcgcacagagtacaaacaggcacaacagcatcacccgtggccccatgttgccggcaatatccatcaaacctttgacaattaaatcaataccgcccgttttctgtagtgccagagcaaaaggcatcatcccgacaatcaaaatgatgctcggccagtgaatggcacgataggcgctttccatatcgatacagcgaaattttcccatcagcaggcaggcaatcaaggcagcaacaaaattgggaatttcattggtcagcatcatcgccaccatcagggcaaggcaaaacagagcatgaggtgcctgtgatgctgcgggagcggcactttccacttcaacgggcaggttcagcacaatgaaatcaggtgttttggttttcaatgcacgaatcagtttccagtcgccaatcaccagtaaggtgtcaccaaggtgtacaggttcatcgactaatttgtcaacaatggctttaccgctacgacgaatccccaccacgttgagaccataacgtgtgcgaaatttcatatcacgcaacgatttccccaatagttctgattcagggatcacagaaacttcggccattcccacatcacgggactgttccgaaaaatattccccgcgcaatatcatcggctctaaccgttgctcgctgcaaaattctcgcagatccacatcgctatcggacatatccaccagcagcacatcctgctggtgtaactcagtttcgccggtggccgctaccatcacccgacgaaacttcctccagcgttcaataccaatcacattggcaccatagtgggcgcgcagattcaattcatccagcgcacggccaatcaatggggaatcttcgcggacagcaagacggcgggcacggccagctaatttatagtcacggatcaagtcacggaacgtacgatggtaacgttcgtccagtttctgaggtgttttcccgcctagccagcgacgggtaacaagcatgtaaacaatccccgccagcaacactaaaatacctatcggtgtaatggaaaaaaaatcaaaaccccgcagaccttcacgcaccaattcactattgaccaccatattaggtggtgttgcgaccagcgtcatcatgccactgatcaagccagcaaaacccaacggcatcatcagccggcctggagaggttttcattctagcggcgacactcaggacaacaggaataaagatagccacaacccccgtggagctcatgaaagcccccagcccggcaactgacagcatcagcagagccagcattttggtttcacttctaccggcaacacgaaccagccaatcccccatctggtaggcaacgcctgtcctcaccagcccttcgccaatgacaaacagagcagcaatcaacaagacattcggatcactgaaaccgatggtagcttcattcagggagagcgtgccactcaggacaaatgcgatgatcaccaataacgccacaacatccattctgactttattggtggtgaaaagaacaatggctactaatagcagggtcaatacccacaacagttcgctattcaatatggcctctatcaacagtatctaatcagctataccttaaggaatatcccatcagcaataccaatctgccgataggcagattgggcgttatcaagagcctatcggtataggcattaagcgcgtaagtagaccatttttctcaggataaatccctcgttaagatcaacaattttcctcatttgaggcataaattgttacataaccgccagatttgctaatttcaatgtcttccagattattgagcacaagatgaagttcatcacgacgtggaatacccggcgaattatggacaaccaccacctgacagccggcatccaaacccgcatgaataccagcagcagcatcttcaaaaaccacacactcctctggcggcagccccagcatactggctcccagcagataaggctcagggttcggtttcccatttttgacactctcagcagtaacccaatgagcgggttcaggcaactccgccactttatggcggacagaagcaaggggaaccgtacacgaagtcactatcgcccacggaatgtccagcgcattgagtttatcaatcagcgcaaccgcaccgggtaaggcagtaactccttctgtatcttctgattcgattttttcaatccacttaaaagtgcgattgatttcctcttcacttgcatcaggcataaaatgacgtagtgatatcatggccggagtaccatgaacaaaactcaacacttcatctctatcgatgctcattttatctgcaaactggcaccatgcacgctcaactactggtaatgaatcaatcaacgtaccatccagatcaaataagaaacctctgcatttcagtaccacacccaactcctccaaacgcaatcatgcgttaataatctgacatatctcaacggtgctcaggtgatattggcgaggacaagacagccataacgccaacatgcgctgatacttatcccacatcggcgtctgcgagttaaacccatgactgccagaatcaaaatgagtatagcgcccttctgtattcaccatgaaacgaacataggcaagatagtgcggctcagtggctgcatcaaagcccaagaataccatgcgacgttcatccagctcctgcttgtctttcaggttgctccatgaaacgtgcagcgcatgatacatttccatgatattgacaataaggcgacaagtctcttcagataattcaccaaaatcacgatctaattcacgcaattgtaacccaaagccccgttcgatgacggtctggtaacgacgatagcgttccgtatgttcaggctccagcatggacatgattttgtattgattagagagaattaggcgttgtgtatgggtcatttccattgtggaactccttaaagagaaggatctatcttgaccacatcatcgcactacccattttttatgagtagcgcaaaacaaccatttattgatctgaaagggggtttatcagttaattgattcagcaaccgtcagggcggggatctgacggttcaaatatcatcaaggaaagcgttatctaattgcttgaatgcccgtttaagcagttcagccagcgagaagtaggttggtgtgctttccacaggcatcatggcaatccccgcttcggcaaatttctcacgaatttcataaaaccatttcagcagcccttctggtaaaggcgttgctgcacgttttcccaaccaccataatccctgcaacggcaaactacaggcaaacagcgcggttgcgacagatggctccaattgcccacccagtgcaatttgccacgtcaagataaagattgccagcggcggcataaaacgaatgccaaaacgggtcgctctgataatgcgattttcagggaaaaccggcgcgagctgtttttccagcggccacgttttcaaatattgctgccctaattgtactctcttaaaccaaccttggttgacaggtggcgtcgtattcatcatgacctcaatcaattaaaggtataatttttaaaaaatccctacaacagataaaatcttttttgtagtattaatactattaagtatattttgtctttattgctagcaaacggtatcctacacagacttttatgttgttgcagtagcaaaacagaaaaattgccctttttcgcaacacgttggttcagtttgttaacagattatttcattttttaacattattcttattcaagattagatcacaacaagataataggtatttccatgtcaagtaagctggtactggttcttaactgcggtagctcctccctgaaattcgctatcatcaatcctgccaatggtgaagaatatctttctggtttagcagagtgctttaccctgcctgaagcccgtattaaatggaaaatggatggcgcgaaaaacgaagctgctttaggtgccggcgcagcacacagtgaagcactgaacttcattgttaatactattttgtctgaaaagccagaactttctgcgcaaatttcagccatcggccatcgtatcgttcacggcggtgaaaagttcacttcttccgttgttatcactgatgaagtgatccaaggtattgaagctgctatcccattcgcaccactgcacaatcctgctcacctgattggtatcgcagaagcgaaaaaaggattccctcatctggttgagaaaaacattgcagtatttgacactgcattccaccagactatgcctgaagaagcgtacctgtacgctctgccatacaacttgtacaaagagcatggcatccgtcgttatggcgcacatggcaccagccacttctatgttactcgtgaagctgccaaaatgctgaacaagccagtggaagagctgaacgtcatcacctgccatctgggcaatggtggttctgtttctgctattgttaacggtcagtgtgttgacacttccatgggtctgactccactggaaggtctggtgatgggtactcgcagtggtgacatcgatcctgctatcgtattccacctgcacgatgcaatgggcatgagcgttgatcagatcaatactctgctgactaaagaatctggcttcctgggtctgactgaagtcaccagcgactgccgttatgtagaagataactacgaaaccaaaactgatgctaaacgtgcaatggacgtttactgccaccgtctggcgaaatacatcggcgcatacagcgcactgatggaaggccgtctggatgcgattatcttcactggcggcattggtgaaaactcctcactcgttcgtgaactggcagtgaaaaaagttgctctgctgggcttcgagtatgatcacgagcgtaatattgcagctcgcttcggcaaatccggcgttatcaccactgataacagccgccctgctctggtgatcccaaccaatgaagaattggtgatcgctcaggatgcagcgcgcctgaccgcataagtagcatgatttccagaaccgccagcaatgctggcggttctctattcatgaatgcattgattaatatttcattgatatctattgcgttgactcatttttcgtctattcatatagcattgagtcacgttgattgactgacgagcaaccgttaaagaggtttccgtgtcccgcataattatgttgatccctactggcaccagcgttggtttaaccagtgtcagcctgggtgtcattcgctccatggagcgaaaaggcgttcgcctgagtgttttcaaacctatcgcacagccacgtcatagtggttctcaggatcaaaccacatccatcatccgttctcactccagcatgcacgctgctgaaccactggatatggcacatgtggaatccctgctgaccactaatcagaaagatgtgttgatggaagaaatcgtggctcgttaccacgcaaacaccaaagatgcagaagtggttctgatcgaaggcttggtgccaactcgtaaacatccatttgcgcagtcactgaactatgaaattgccaaaacactgaatgcagaaatcgtgtttgtcacggcactgggcactcattctccagaacagttgaaagaacaaattgaactgagccgcgcagaatacggtggtatcaaaaaccagaacatcattggtgtgattgttaacaagctgaatgcgcctgttgatgatcaaggccgcactcgcccagatttgtcagaaatcttcgacgaagcctccaaagcaaccgttgcctacatcgatccaaaaaccgtattcaaaaacagcccactccctattctcggttgcattccgtggagtttcgacctgatcgcaacccgcgcaatcgacatggcgaaacacctgaaagcagacattatcaacgaaggtgccattcagagccgtcgtattaaatcggtgactttctgtgctcgcagcattcctaacatgctggaatacttccgtccaggttccctgctggtcacttctgctgaccgtcctgacgtgctgatcacggcatgtctggccgcaatgaatggtgttgacgtaggtgcagttctgctgaccggcggctacgctattgatgattctatccgtgaactgtgcgaacgcgcattcagcactggcctgccggttttcacagtgaaaacaaacacttggcagacctccctgaacctgcaaagcttcagcctggaagttcctgcggatgatcacgagcgtatcgaaaaactgcaagactacgttgcacaacacatcagcagcgagtggatcgattctctggcagcaacttctgagcgtccaaaccgtctgtctccacctgcattccgttatcaactgactgagttagcacgtcaggctggcaaacgtatcgttctgccagaaggtgacgagccacgtacggtcaaagcagcggctatctgtgctgaacgtggcattgcggaatgtatcctgctgggtgatccggaagaaatccgccgtgtagctgcggctcaaggtgttgaactcggtgcgggcgttgaacttgttaacccagccgccgtgcgcgagcgttacgttccgcgtctggttgaactgcgtaaaagcaaaggcatgaccgaagttgtggctcgtgaacaactggaagacaacgttgttctgggtacgctgatgctagaacaaggcgaagttgacggtctggtttccggtgcagttcacaccacggcgaacaccattcgtccaccgttgcagttaattaaaacagcaccaaacagctcgctggtttcttctgtcttcttcatgttactgccagaacaagtactggtttacggcgactgtgcgatcaacccagatccaaccgcagagcaactgtctgaaatcgccatccaatctgcggattcagccaaagcattcggcatcgatcctcgcgttgcgatgatttcctactccacgggtaactctggtgcgggcagcgatgtagagaaagttcgcgaagcgacgcgtctggcacaggaaaaacgtccggacctgatcattgatggtccattgcagtacgacgccgctatcatggcagacgtagcaaaatccaaagcgccaaactcacccgttgctggtcaagctaccgtgttcatcttcccagacctgaacaccggtaacaccacttataaagcggtgcagcgttctgcggatctggtttccatcgggccaatgctgcaagggatgcgcaagccagttaacgacctgtcccgtggcgcattggttgatgacatcgtttacaccgttgcactgactgcgattcaggcggctcaacaagaaaacgcgtaattttctatttcttgagtcgttttatctggttgtgagaaacatgatgagataactgagacaggtaaaataaccccattctttttggctggggttatttttttatagtaataatcaattaaatattcgataagcctttttataaaaaccataatattaaagactaatataaatccctttgctccatttaattaactatagattaatttaccactctttcttctgttgcatgttgcttacgacttttccgcatgcgccacaaaacttccaatatcacaaaccaaatgggtgtgccatataatgcaacgcgagtatcgtagtcaaacaccataatcactaccgtgaaggcaaaaaatatcaaggtacaccatgtcattggtatgcccatgggcattttatagatggaaattttatgcagatcagggcgttttttacggtaagccagataagcaatcaatatcattgcccagctataaatgaccatgatagccgccaccgttgagacaatggtaaataatttcatcacgttggggacaatgaacagcaggaatactccgcttgccatgcagataacagaaaatatcaaactgaagatgggaactgcactgctcactgagagttgggcgaatttaccatgcgccagcttttctgtggacaagccatacagcatccgagtacacgcgtataagccactgttagccgaggacatcgccgaagtcagagcgacaaaattaatcaccgccgccgccgcaggcaacccagccaacgcaaacagcgtcacaaacgggctgacttcaggggaaatattctgccacgaagttacggcgataatgcacataatggaaagcacatagaaaatgatgatcctgatgggaatagtgttgatggctttcggtaagactttttctggttctttagtttccgcagtcactgtgccaaccagctcaatgccagtaaaagagaaaatggcaatctgaaagcctgccagaaacccaaacatcccgttcggcaagaacacttcaggatcagtcaaatgacgaacagacgctgtcacgccattaggcgatgtccatccgacaaacaccatgccgacaccgacgataatcagtgctacgattgccacgactttgatcatggcgaaccagaattcagtttcaccgaataaccgtaccgaacagaaattacacaaacatatcagccccaaaagtgacagagccgtgaaccagagtgagacatcaggaaaccaatattggatatagccaccacacactacaacatccgcaatacagctgacgacccagctcatccagtatgtccagccaagaaaataactggctttctcgccgagataatccgctacaaaatcagcaaaggttcggtaatccaattttgtgagcaacagttctcccattgcccgcatgaccatgaaagcaaaaaaaccgatcatcaggtaagtcaggattattgaagtgcctgatacagcaatggtttttcccgttcccataaacaaccctgtaccaatggctcctccaatggcaattaattgaacatgacgtttgcctaatccgcggtgaagtttctgcgcacctgcggattgctccacaggtgtttttgccgtcctcgtcatcgataacctccataggattctttacgttaattgcaccagcaatagacccgcacgctgaccaatggcaacatgagcgttgggaaatagaataaagtttgcaggagaagcaattttccagaattgattcggctggctggcaatttcgaacccgtccggcagcgcagtgaagtttttcgtatcctcaggaatatggagccgaaaactgtcctcttgtttgataatcgcgtcgattacacggtaacgcttcattgtcggtttttcccgtttaatcaaaaacgaacccgccacgacatcgcgtaatgcaagcgtaatattgttgaatctgctcaggtcgttctgcccaaaaggacgcgctttacccacttccatcgtgcaactctctacgttgaaatgttcactggtaaagtgactgaacgtcccgcctgctgcgttatggaagaccagagcatcaatatcgctcccctccagccactgtaggaaatcagatgcatattcacgagcctgaaacggcagcaaggcaaactgttcatggcaggaaccccgaattgccgtatgcagatcaaggtgccagcgccgtgttgatgccctaaccgctggctcacgaaagaactggtgaacaaccgcttccaactccatcgctcgtttcgattcattccctaaaggaaaattctggtgacggccaccaaacatgcgattgagatcattatcgatataacgcttattttcacgcatggctgggacattaccgaaaatcagcagaaggttgtgctgcaacggtagatttccctgagcgagttgcgacaccagctgaatcaggatctccacgggcgcggtttcattcccgtggataccgacggagagaatcaacgtatccgctttgctctcctgtggcagcaactgcaatactccctccgccagccatgaggcttttaaagtgggagggaaatgcagagcatcctcaagtttcttttcaaacaataagttcaataaatccattttttctcctgattaacgctgaaactcatagatcgaaccgagcttgaggatctgagtcagttcatcaagggcaaaatagacttcattcagcaattggggatcaaccaaatctgcggtatacagggaatcacgataataccgttcaacccaagaagtcaggcgttgatacagttctggcgtcatcaaaacagcctgattcaccgccgctaattcctgttctttcaagacgacgcgcaaccgcaggcaggcagggcctccgccattacgcatactttcccgtaaatcaaaaaagtggagtttcttaataggggaatcagcacccgcaaccaaagcctgcaaatatgcccagacattagcattctggcgacattcttctggcaaaatcagcatcatatcgccattaggttggctcaataactgactgttaaaaagataggattcaaccgcatcctgaagcgtcacttgtgatgaagggacttcaaccgcaatcaatttttgcccaagccgcgccattttttcctcaagttcagctaatacggactgctgattcacaagcgcctgctgatgatggaaaaaaacattgcggttactgacggcgatcacgtcgttatgaaacacccccctatcaatggcgacagggttctgctgggcaaataccgtttgagcggcctcaagttggtgcagacgagcgaccgcctggctggcttccaatgtctgccttaccggatagcgtttaggtgccgcgccttcctgtaaaacactgcggccatacacaaatagctgcacacccgcttcaccatattcgccgcagaaacgattatggtttgccgcaccttcatctccccaatcaccatgttgaggtaaaggatcatgatggacaaaacaagcctgatcaggaaagacggcttccagcactcgcgcggtgactgtactttccaatgaacgatgcagtttgttattcaggttcgccaccgtaaaatggactcgttgatcagcactgtcagcagaaggtgaaaccgttgccgcatttgctgtccacatggaagaagcggaactgagattagacagcaacaagggtgaatatcgtgcaactttgcttaatacctgctcatcactgccagtaaaacccaactgccgcagtgcgggaaggttagggcgctgctgcgggggcagaaccccctgaaccagccccatatcagacagcgacttcattttcatcaatccctgaagcgcagctttgcggggattggactgttgcccccgatgagtcatcgaggcttcattacccattgacagcccggcgtaatgatgagtcatacccaccaggccatcaaaatttgcttcaattcccgacataattacctctgctctctaagctattaataacaaaaatcaagaacggaaaaaatccagacccggcgcaggtgcatcaggtaaaaccagcttgtctgccgtcagagatgccattggccaggcacaataatctgcggcatagtacgcactgggacgatgattgcccgatgcaccaatgccaccgaacggggcagcactggatgcgccagtcaacggcttgttccaattcacaatccctgctcttgcttcctgcaacagatgctcgaatagagcggcatccggcgaaatcaaccccgttgcaagaccaaagcgcgtatcatttgtgatggagattgcttcctcaaaagtgtcataacgcttcaaggttaatagaggcccgaaatattcttcgtcaggaacctctttggcatcggtcagatcgataatgccgggtgtcataaacgttgagtcaggatcaggttgagtcatagtcaacagcgaaaccccgcccaatgcctgcaatcgtgactgagcatccagcagattttctactgcgggcaacgagatcaccccgcctataaacggttggggatcggcatcccagcgagatggaataatctgacctgcggtatcaagtagccgttgaatcagagcattccccttctctccacgtttcaccagcagcctgcgggcgcaggtacagcgctgcccagcggaaataaacgcagattggatgatggtgtaaactgcggcctcaagatcgtcataatcatccacaatcagggcattgttgccgcccatttccagcgccagcattttttcaggctgacccgcaagcacacggtggaaatgaaaacctgtcactgcactgccggtaaacaacacaccatcaatttcacggctatccagcaatgcaccgcctgtttcccttcccccttgaaccagattcaacacacccgcaggcaaccccgccttgatccataattgcacggttttttccgccgtcatgggcgtcaattcacttggcttaaacaccagtgtattaccggcaatcaacgccggaacaatatggccgttaggtaaatggccggggaaattataagggccgaaaactgccatcacaccgtggggacggtgctgcaatatcgccttgccatctggcataggcgtttctgaatagccagtccgctgttgccatgcttcaatggaaatagcaactttaccgatcatagactgaacttctgtccttgtttcccacaaaggcttactggtttcttcgctgatcacacgggcaatggcttctttttcctgtgtgagtagatcagcaaacgcctgaataatggctatgcgtttttcagccgtcagtttcgcccattccgggaacgccctgcgggcagattgacaagcgtcatttacttgactggcagaagcactgtttgcctgccataaaatccgctgatcaagaggagaatatttgatgacgggttcgccttgccctgctacccacccgctaccgatataatttgcttgatgattcattgtgaagatccctcagaaaaaagagaaataaagcgcacagcatccccctcatccacatggagcacttccatctccgcaggagtcagttgcagttcatcatgactaaacggatcagggatattcaggagcagtgccttaaagtcctgaaaatgcacattggaaacaatacacggcaccccatcactctgtcgggagaccttttcgctttttttgacataggcaagccgacttgccttgatcgaacgcacattatcaatttctgcttgcaagatggcgcctgcatcaaaaatatcgaccccatcgttatagaagaaaccttctttttctaagatggcgcgagcgggtacggtattctcatgcacctgaccgatggctttctgcgcatcttccggcagtagtggtacataaatgggatggaatggcatcaattccgcaataaacgttcttataccaatgccggtcaagtaatcggcctgagcgaaagggatattgaaaaagtgttgcccaagggcattccaaaacggggattctccctgtagatccaccaccccacgcatttccgcaaaaatagattttggaaagagatgcctgaatgccgaaataaacaggaagcggcttctggaaaggaaaacaccattacctcccccctgataatcaggatcgaggaacaacgtacataactcactgcaccccgtataatcctgccccaccataagcgtttcaaatgtgttgtaaacgcccagttcacgggatgcacgcaccgaccgctgtaaacggaaattatagaatgcttcttccagccctaccgcaacttccagtgcactaacaccaacaacacgatgcttctccgtatcttccagagtaaataggaatccctgctgtgctcgtccatttacatcgttaaatgaatcaatgctgcgtgaaatccgtgccgtcaggtattcctgattgtgtggcagcgatgtcagaccaacgccagcacgggacgaaagatcgagaatatcccctaaatcttgatgttgaacggatctaaatagcatcatgatatcacctcaaacctgtattattcctgaacaaatcgcttgagggcgttttcaagacgggcgaaaccgtcattgatgtcctgctcttcgatatttaacgcaggggcaaaacgcaacacatttggaccggcaatcaaggcaatcaacccttcttccgcagcgatattgctcagggttttagccttaccctgatattttttctccagttcggctcccagcagcaagccttttccacgtaattcactgaacacgtgataacgttggttcaaatctgacatacgcttgatgaattcatgatgacgctcttgtactcccgccagaaattccggttggttgactaaagcaactacctgattggcaaccgccgccgccagcggattaccgccgaatgttgtaccgtgtgaacccggctggaaaacttctgctataggctgtttaaccagcatggctccgataggaaaacctccaccaagacctttggcgctagtcaggatatctggctcaacacctgtttcttcgtaagcataaaaataccctgtccgaccgactcctgtttggatttcatcaaaaatcaacaatgcctgatgttggtcacacagttcccgcaaggctttcaggaaggcaggatcagcaggaatgacaccgccttcaccaatgatgggttccacaatcacagcacaagtattttccgaaatatgggctttgatagcgtcaatatcgttatagggaagatggctaatttgttgcggcaatggagcgaaatcttgtgaatatttgggttggccgcccacagtcacggtaaataatgttctaccgtggaaggaattttcgaatgaaatgatttcgtttttatggctgccatatttatctaaagcatattttctcgcaatctttagtgcggcttcattcgcttcagcacccgaattacagaaaaaaaccttatcagcaaaggtattttcgacaagtatttttgccagtttcaaaacgggctcattcgtataaccattaccaacgtgccacatactttctatttgagaagttaatactttctttaactcatcattggcatgtcccaatgaattcaccgcgataccaccggcaaaatcaacgtactctttcccttcctgatcccatacacgagagcctttagctcggacaggaataaattgagccggtgaaaaacaagggaccatatactgatcaaaccagcttctctggatcgtgtttgacatttatttttcctcaaaaaagtaaataactaaaataaaaatgaattgatataccatgaaatgtgattttttaattaatagacttactcatattttctattaattatttcaattagtttccaattacattctatgaatatctttttccatcctttaagattgcaagctggatgcatcatctctttgaggtttaacaaagtcaatacaatgagattacaaataatttactttatgatgtttttcacaatttataaaagcggttttatttacaatttatgcatagtttatgcataaaaaataaataaaaagaagcataaatgaggagataataggaatcaacctgaattgttcaataactattcatttatcatgtaagtattttacgattacaatttcaaaaaaaatttgcaaatagccattttactttaaaatctaataatatacttaaaaatcaaaacgttaataaatatcatcctgaaaaatctgtattccagagacaaaaactacgataaaagcggcacaagagttcagcaatttacctttaggtcatgagttaactaagaatctatcccagtaaacgtaatgttgtacacagactgtccgcagaaatcggagcgtacacgtaggtaatcaagaattagtacgtgagtagggttcgctgcgtacctcctttcgaaccgcattgaagtacgttcaaaagctatcgctttaatctgaacacagccaaaattcaaaatacctaataaaatagccctaataggatgggatttatacctaatagacttcaagattaaagttatttctaacagattataaattctgtcttccattccatttgtattctttacaacgctataaattttaattaataaaaattataatttatgattaaatatatttttaactatcaaataaaataagaattttaatatcaatatatattggcacaacaggaagaaagattaattaaaataaatacaacaaggtaaaatatattttactgaagataaatactatgaaaatttcaaagagagaatgtatatcttttgatgttagaatgtcaaccagcgaaaacattacattaataaactatataaataatttattaaactattgacaagtaaatgaagaaatattatagaaatacagagatagcttattttagttgttaaattccaaacaatataattaaaaaatatctttaacaaacataaacttaagattttctcaaaaaggtagaaaatgattaatcaagaattgataaattatatttttttgatgaaaatgaaggagtagttgaatatacaggcttaacatttaatgaatacttaagacatgttgtagattatgatacccgtaatgccacatgtaaaataccatttgaccgttcaggtgatttacttattctctaatttttagtattaaattttaaagacttcaacttaaatgttgaagtcttttttgttgtcatccttaaaccacctccataggaggtggtgatcgttcctataaggcaatgcccatcacgcctgaacaaattgaaatatgtgaacttggctcagtaccgggatgtccggtgcaagaagacgtcgaaaacactctgccgggcgctaacgggaaactggcagcctgaacattgttagccaaattcgtggctaatcacacacgatcttgccctttctcttaagccaacttagacaggttctcgttgtctactttaattacagatgctataacctacccatccatttacccacagagaagaaaaggaggttaattatgatgttaagtgatgtgattgaatattcacatttctttggtaatcgtcagcactcaggcttatctactaacgcattgcgttaatcctgcctgagcgaagtttttaccaatttaatatcccttcctcagcttacagggttatcgcgttttatgacccaaggtgttatcacgcctaaaatttgagtaagctatgagtacattattatcaacccaaaatctgtcattccatcacggtcacactccactgttagccgatatttctatcgccattaataaaggcgagaaaatcggtctgatcgggtataacggttgtggaaaaagtacgctactgaaattactttctgcccaattatcaccgaatgagggaaccgtaacactggcaaatcactgcattctggcctacatcgaacagcatttaccggctacattgcacagtatgacgctgattgaggctgtgttggataaactgcccgcagaacaacgaattgaggacaattggcgggcggaaattttgttgagtgaaatggggtttcagccggagcagcacaatctggcgatctcagcacttagtggcggtcagcatacgcgcttattactggcacgggcgcttatcattaatccagatttattattgctggatgaaccaagtaaccatctcgatttgccgacaattctctggctggagcaatttctaacacagtggtgcggcagttttattctagtttctcatgacaatacgctgttggatcacttaacgaattgcacctggatattacgcgacggtaatgtgtctctctatcgtcttccgtgctcacaagcccgtgaagcgcagacagcacaagatctcagtgatgaacaccgtcataacgcgcagcaaaaagagattgatcgcatcgcgcacagtgccaaacgtctggctatctggggcaaagtgtacgataacgaagcgctttcccgtaaagccaaacaaatggagaagcacgtcgatcgcttgcagggctgtcaggttgaactggccgttagcagccaatggcggttgaaactgaccggtgatgctttacgtgcagatcgcctctgtgcgttcaatcaactgacagtgagccctgcaccgtcctgcccaccgctatatgtgacagataatttgtccgtgaaaagcggtgatcgcattgcgattatgggtgcgaacggaaccggaaaatcatctctgttaagaatgattttggcacaatcgcaatctcaggctctgacgctgccggatagtcctcttgtactgcatccgcgtgtcaatcttgggtattacgaccagaaactggcacagttgtccgatagtgatacactgtctgatgccttaaaaccgtttgccgcgctgatagacaaacagcggaaaatggcgttgatcagcgcggggtttccgtatttgcgccatcaacaaactgttgcatcactgagcggtggtgaacgcgccagactgttattcatcggcctgagtttggcgaaatattcattattgatgctggatgaaccgaccaaccatttggatatggacggtaaaaatacgcttcgcgatgaaatccggctgttcgctggtggattattgctggtcagccatgatcgtgaattgattgagcaaagctgtaaccgttattggtatattgatggccagcgtttaacggaataccacgatttggatgcggtatatcagaaaatccgtcacgccaatagcaatacacaaacggacagtgcatccgtatctacgttttctctcgtaccatcatcggaaatgttctctgatgatgacgaaatgaaactggcagagctaatttcactagaggaaaaactggcgacggatttgcaacgcaaggccgcacaccagaaaccgatattgcaacagcaatggcgtgagaaaatagcccagttgcgtcaacaattgtcgttggattgacatatatctgttttgaaaataaacatccggcaaaccaacccgccggatgtttataataatcacttcaataccagcgaaatatcttcatacccaacacaaatgtcacaatcccaatcaaactcaagataatcgctgcaggtacgacctgcaatagatcaccgccttcaataaatactttgcgcatattgtcggccaaaatggttaatggcaggtattcaataatattcgccatccactgcgggaagtttttgtaactgaaaaagatccctgacaacaaaatctgaatcaaaatggagacttccaacaatccattcgcggtttgggctttgcgggcgcgggatgccaccagcactgccacaccggaaaagcaaatattccccgtgagcatcaagagcaggaaggcgtaaaacgagccttgtatttctacatcaaaatagaggtctgcaaacaggtagatgattaatatctcggtaatgctgatcaacaggcaggagaggatatgcgccagcaggaatgtggatttgcgcatcggagtaatgcacatctgacgagtgacccgtgtgatacgtttttccgccagtgcccagccaaccgcaatcaggcaagtctccataatcgccattgccagtaagcccggtaccaagaaatccacatagcgcagtcccggtgtttccagtataaacaggtttttttcagactctattccttcctgctggttgagcaggtaataggtcaataaggcgtcactactctgtggatcaaggtaatggacgcgttttttctctttatcctgttcaatgaacatctggatatcccctcgtttcagcccacgcacgacggcctcatgatcgggataataggtgatgttgtaccgaactttaaccaacctttcacgcttgatctcttctttattaataatccctgagatcatgtgctcctgcgcagtcagctgctctccccactgtttcatttgctgctgttgtacggcttccacaggcagcacgataccgatttttctttcgggaatatcctgagaggagaacgaaacccccagtagccagaccagtaacagagggaaaccgaacgaccagaacaggatttccggctcacggatatattgccggaattgcgtattcatcaagttgatcagtgcgctattcatgtaaccttctcccggccaaagtcatgaacaggtcatccagcgttttcttcctgaccatcagttcaatgatgtcagcctcgacttgtttggcaaactcaaaaagatgagcaacaaaactagtggaatcttcaatcagcatacagatcttatctttcctttcatcgtactcataatttaagacttgagcatgttgactcagtgcctgcaggcggtcaggaaaatgggtacggaattcaatgagatcgccatcgcagtgttttttcaacaactcatctatactgccctgtgtgataatttctcccttattcatgatacaaatgcgatcacagagatattcagcttcctccatataatgggtagttaagatcatagttgagtgcttttcacggttgagtttacgcaggatatcccaagtatcatgacgaatgcgcgggtcaagcccggtagtgggttcgtccaggatcaggatttccggctcattgatgatggccacacccaatgcgagacgctgacgctgaccaccggataacccctccacataggttttgcgtttttcttccagctcgaccagttccataacctcctgcgctcgtttgcgtgaacaaccataaaagctgccaaacaggttaagcgtttcttctacactgagcttatcgataaacagggtctgctgtaagacgccgctgaggtgctgacgcaggtaaggtgcatcctgctgccaggttttgcctaatacccgaaccgagcctgaatccggcgttttcagcccttccagtatttcgaccagtgtcgttttacccgctccattcgggccaagcagaccaaggaattctccacgatagacatccagagaaattccttttagcgcttgatagtccttgtagtgcttcttgacctgttcaaactcaatcactttctcgttgtgttgaatacccataaaattctctgtatctcatttggtgataagttgtgctctcactaaagagtgtgacataaatattggtaacgtcattttcccatcgtgtgaacttcaaaagtactggcgtcaagcagtgtccaaatgtcattttctgtcgagttattttttgtcaaatcaagatgatatttctcagcacgaagcaatctcatggcactcagtctcatcgcgctggtatgggatatttcaacgcctttcgagacaccggcagtcttagatatgtagacgatacaagccaatgggtcagaatgaatactcacatccgggttatgtaatggcatggtctgaataaaggctttttcgctgtcaatgcagaggtaatctaccttactttcatcaaacagtgattgatactgcaagacgccaatgacaagctcgatacccgcatcttcaatgtaaaaaccgattcgctccgctccatgggtgctgttaatgggcaggtaagccagtcccgctttcaggattgccaaaatggataccagcatctcttcatcatgttccagacagatgccgataacgggtgaaaaggcgtccgtttcccccatctgctgcttgatttgcaggatataatgcgccagttgattggctctctgattaagctgctcataagtcagccccagcccgttctcagtattcagcacaatagcctgtggatagcgctgtaccttctgctcaaacgcctgatgcagtgtctgagtcaatctcaactgtttttgctccaggggggctttgggttgaaatgtatgtttttgcatatgcatacgacctccggcaaatttcattgttatacctttcatctttcaagttgcggctttgttggctgcaacttgaaatctattaggtatggagtgagtttgattcagcatcaggacgacgttcccaaacaatacgatcatgatggctaatgcacctgccccccttttcaacgaggtgaaacaggcggcagtagccatcttccttcaacaatgcagagttgcgttatgcatcacttcctaacacatcgttgttcaaaacaaagggatcagcatctttcagaaatgggaaacgttccctgacaccctgcacatgggagagtgacagctgcacggttttcaccacttcgtgattcatttcgtgcagcagtacttcacccagtggatcgatcaacatagtgtgaccgtcatagtctagttggttgccatcctgcccaacacggttaaccccgataacgtagctctggttttcaatggcgcgcgcctgaaggagcgagcaccagtgagccgaacgtcttgctggccagctggcgatgtagatcgccgcatcataatgaccattgacgttacgcgaccagacggggaaacgtaggtcataacagataaaggcagcgattttccaacccttgaaattcaccaccagcggggcattgcctgcggtgtattcgtgatcttcttgggcgaaagtaaagagatgctttttgtcataatgagcgacagagccatcgggattaacccacagcagacggttataaaagcgctggttttccgtgataatcatgctgccgacaatggcacaatctttcttggcagccatcgctttcatccactgaatacttggccctgtcattgtctcagcaatggcctgtggcttcatgctgaaacccgtggtaaacatctccggtaagataatcagatcactacccgtgatctgagcaatgtgccgttcgatatgttcacggttttgttccgcattttcccaaaccaaatcggtttgaaccaacgtcaccttaagattttgttcaatcattgaaagctccgatttaacccatatttctgtcattacttgtctgttattcgattgttttataaacaacccttgaaaaagatcaggatccagatgcagccataccgcatcgtatatcctcattacaaatcagcatcaaacagttgttccagatagctcccccgtacagatgcttcccgtatttcagccctttctccctgctgttgtggcggcgcaataaactcacattcgatcaggtaattgaagtaatggaaaagtagcgttctatccgacagggggcactgaattccactgccactgagtaattcagttgtcagttgtgtggcatatttggctttttcggtcagttccatgccggagtaaaatagccccagcagatcggtaaagaccgagcgataaggctggccataacggtacaggcggttttgtgccagcgcttccatgtaatcattcatgttaatggtatcaatacgataaccaaaatcgcgcaggaaagagacgatgtcattgaacgtaatcgggttagggttagtcagattaagcgtcttcccattaaatttctcgatattgaaaatggcatacagcgaggcttccgccacgtaatccacaggggtgatatcaaaatcgtcctgtgcattgaacgtcagcccagtttccaccaatgctttaaccatttcgtaatagatgcccttgaccttggtatgcgctaatgggtaacgcccattcgtactttctccccaaatgttgcccgggcgcacaatcacccacttcagtcctttttttccggcactgtgaataattttttcggactcaaatttggagcgttcgtaatccatgtcatcaaatcgttgccccacgtccagatccgtttcatgcaggacaaaaccgtccttatacaggcaatcccccgccatgctgaagctggaagcatacaacatcgctacattaccctggaggcagaaatcaatcacatgctgtgtaccctgcacgttaacaggcgcaatctttttataagacgccacaaggctaacgttagcagcgcaatgaatgacccggtcaactttgtcagccagttcgcaataaagctcttgtgtcagccccaatctttttttagagacatcccccagtaccggaataatccgatgatgagtgttctcactttgtttttcctgatcgtaagcaaacaagatacctttcagacgttctattgcctgctggttgttttctgcccgtatcagacagtaaacctcaatatccgtcgtcgtcagaatttccagaaggatccttccccccatcacgccagttgcaccggtaagcaagatactactgacgtcctttttattatggtcgaacatatttatcccctaaaagtcatcacatagcggcgaaagtatgagatcaggcagcaaagcgcctgatcttactaatattttattcccctgtgcggctataacgttccgacacgcattccgccatccaatgggatcactgcggaattgaggtagttagttttgcaactcgccaaaaatcccacaacttcagccacgtcatctggcgttccccaacgcccgaccggaacaatggaacgtacaaccttatcctctcccgccgactccatcgggcctgattccacaaactgctccaacatgtcggttttacagacccctggagcaacggctgtcacactgatattcagtggacccaattcacgcccccaggattctgtcgcagagatcagacccgcttttgaagcgccataagcggaactgcctgccgctccccaaatgccggcaaccgaggcaatgttgatgatgcgcccatatttcaggcgcgccatgtagcgaacaaaaattgatgtgctgttgaaggcacctatcaaattgacgtttataaccttggttgtctcactaaacccttggccagaaagacagaatgctcgattaataatgccggcgttgttcaccagcactgtaatggtgtcaccgaatgtttcaacaatctgttgcgccgcccgttctaccgaggctaagtcagttacatccatttcaaaggttgcaagggattcagggtgtccgagacgctccttcaggagcgccagtttttggctactgacatccgttgccgccaccagataaccaatatccagcaacaccttgctaatcgctgtgccgaatccccccgctgccccagtgacgacagcaatttgtcggctcatgcatcaattccttctttgaatgcgatatcaatgactttgcgagcatttaccatcgcatcaaagatcctctcttcaaagaaacgcacgtcatcctgtgacatcaacaggttagagtacatgcgagacaatggtgagaactgaatgccatagcgtttggaaatttcacgaatgatgatgtcgcagaatttgactttatcgctgtagccttccgtagaactaacaggtgtgctctgggagtgataaaccagcgcggttggcattccttgtacgaccagtggcaggtcaaccgctttggccgctttcacgaacacgtcggagatctgacgcatgatattccccatacggtcatagcagccgggatctcgttcaatcaaatcaaaggtcgtctgaattgccgccagacccagtgggtaaccgttgaaggtgcctgcatggatcactttcccgcgggtgtacaggttcatgatgtcactacgaccgacaatggcagagattggcatagagccgccgccaagggctttcccaaaggtcgccagatgtggcgtcacacccagtagtttttgtgctccccccagtcccaaacgaacacccgtaatgatttcatcgaaaatcagcacaatgttgtgtttttcacacaatgctttggttttttccagatagccttcttctgggaagatcccgccaccattgatgcagagaggttccatcagaacagcgccgatttcattgtgataacgttcaatagtcgccgtcagaacatcaatgtcattccagggcaacatgaacgtttggtctaccatgattttggggtcacgtcccagtgtatccagcaggtccccattgaactgctctggcacggggtaagtgagatcctgctttttacgccagcccatgatattgtcggcattaccgtggtaatggccatggaagcggatgaagcgatttttgcccgtaaaggcacgggcaagacgcagcgcattctgtaccgcttctgtcccgctcaggcagaaacgcaccatttctgcacagggaatatgtttaaccaacgtttcgcaaacacccacttccagatcgcaggtatcaaccgaagtcactttacccatgtattcgatcagggattggttataagcctcattgtggtgtccaaccagcaatgccccaaatttacagaacagatcgagatgttcattaccatccaaatcccacacacgggaattgcgcccacggttgaaagggatcaccagcgggcgctcaggatcaccaaagttgtaatgcgtaccaccaggcatcagctcccaacattttttgtaaaagtcctttgaattatccaatacgagttttgttgaagcgtccataggttctttactcctcacctgtgatttttgaattgacattaagttaagatgacgatcatcaacctgactgtggtcagcaagatcgtcgttagattgttcatgactaaattcatttggcggggaattttccccgcccgtgtagaaatgcaacggtagatgccgtttaatctgctcaggcacagcaatattgaataattcaagtagggtaatgcgagtgagataggccgctcccttcatcagcaattgggcaatttcgctgacatgcctgttttccactgcttcaaaaggcgttccttgcagccattcgttcatggcacccatcgccgcaccacaccagatctggtaatctagattgcgtactggatcacctgtgatcgcccagcgggatgattggccgagataccattggaacaccaacgccatctttgtcttcggctgtttttccgctttagtaatgatgtccagttggttaatactctggaaataggcaatagtttcctgccagatttctgtcagtggtttgtggaatatctgtttctccagcagagcgatttcctgtacaggcagggtgtccagactgtcgtgctgcttatacagattgtacaatttttgtgctctcacagcatacatactgccctgtttcagtacctgtacttttgcccccagttcaaacatgtccgctgagggtgcagtggcaacatcattaatttgagcctgccctagcatttttttcaccgcgcgggatgtgccggcttccacacaagcctgattgatcgagccagtgacaacataagccgcgcccagagcaaaagcggacagaatggcatgaggtgttcccagaccgcccgccgcgccgatccgcacctgatagtcatgttgagtttcgtctgcgatttcatcccgtagctggacgactgagcggaaaatgcaggcgagcacgccctgatcagtatgaccccctgaatccccttctaccgtgatatcatctgccatcggtatttggcgagccagttctgcctgctcaggtgtgataagctcctctaccagtaatttttgcaaaatcttttccggcgctggccgcaggaagttctgagcaacttcgcgacgggaaactttggcaatcaggcgatgatgacgcaagatagtgccatcaggttgttgtaccagaccactaacgcggtaatagaccagcgccgagctaaggttgatgtaggccgaagcttcaatcacccgcacctgattttccatacacaggcgtacacaggccatttcccattcaggattaccggggttatgcagcaggttgacgccgaatggaccttcgggcaatgtctgccggatacgggaaatcgcctcagcaatccgtggaatacgcaggccacctgaaccaaaaattccaagaatgcgctgttttcccagcgcaataaccatttcttcagagtggatgccatttgccatcgcacccgcgtaataggcataattcacgccataatccgccatgaaacccgcatctcccaaactgcctgccgtcactgctggcaggcgaccaagcagagtcgtctgttctgctattgtgtcatctggcaataacagtgatattgattcacccaccttcacaacacgcagttcagtcgccagcgcctgcaagtgggagatccctatcgttagcggtaacgctgtcagttgatggctcgatttattcacagataagcgctgactcattttaaagcttcctgtttcagttctgccgcaatgatctggtgtggcttgcgtcgcacgtatctcacgcccatgttgtcactcacgccaaccacattgccgcgatagagcgtctccgcaataaaaaacaaagtaatagactccagcttgtcatcagaatagatagcatcaacggatttacaggtcagccggaactgcaccacatcccgttcgcatttcacttcaccacggaatttagcaccggatgtatgttcagtcagcgtatgcgcttccagatcaggctgtgaattcaatccaagatagaacagatagaacttcatcaattgttcagagccttctaccagtaaagtccccggcataaccggatcgttcttgaagtgagctttgaatgcccaatgtgcgggatcgatatctaattccgccacaatctgccccaaaccgaatgcgccacccaccgtatcgacactcaagatccggcttaacatgcgggtatccgggacgcataacttgccttcccggttatattgatactgcgacccgaagcaggcagcgagatcaccattcatgacgttagtgatgtcccgctcattgaatgttgtccgatcacagtgcagcaacggtgtaaagggttttgctggaatgctatttttgcctttggcaaaataagcgctggtatcaaagttacctgcgttctcaatttctttgcggccaaagaaaccggagttggccaccagccggaacaccagacgttcctccacatagcaaagatattcataagcgactaaagtcaagccgccgacccgcacaacagaggtgatattgacgcgtccacgcaacacatctcccgttttcggcatctcgctgtaaatcgtggtattgcagtccaccgcacggtaacagcgctgtcctttgaacatcaggtcacagccaatcaccgtaaacgccacgatcatcgcatgggacgattccagcgcgacgaacgatggtacacggccattcacggcataccacgcatcttcaggcacgtcgtactcccattcgatatagcagggttctaacttgcctttgacggcagaaagtgccgtaatgcgcgaaacaaacatgaaagggggtgatggcatacgcgtacgtatctggtagctatcgacttctgcataatcagcacccaaaactttttctacactgccgtctgtcaattccagaacttgctgctcgtcgaaaacggcgggtgaggttgtcactctctttttcgtcggtgcaaccaatgcggattctgtggttttagactgaattaagggcagctctgccagatgctgtttaagcaactgataatacgtctgctccaattgcaggtaatgcagttgagtatgggcattgcgtatgaagtgattaagttccatcggcaatgacatattcagggttgatacttcgggagataccacttttgtttcggcatctgccggtgtcaccgccatattgacatgcgcagccgcagccagtgacgcaaaacgagccaatgtctgttcattgaggattaactcttcaacggttttttctcttgcggtatacgatagaacttttaagcctgcctgatttgactctggacgactcgttgggcgagcgcgctttccgctctgtggttcacttaagatcacatgactgtaagcccggtcaatacccaagtgactgattgctgcacgacggggaccttttgccggtgcaggccaggattgggtatgagccggcagttggaatttcccttctgcataatgcgccaattcctgatgctgcggataatctggcagtgccggtaagtatcgctgtgtaagctgtaacgcggatttgatgattccaagcaggcccgtggtcataaacagatgtccgtagttggccttaacggtgccgatggtggcggtcagttgtctgttttgtgaagcataaacccgacctaatgcagacatttcagcggcgatctcgcctggtttcccacccgcatacagttcaatgtaatcaatctgatcggctgtacaacctgccgcttctaatccggatctagccgccgccagaatcgcgtcttcgtttcctctgaaatcaatagagtgatcaggcatataggtgatgctgagcccatccagtacagcataagcaggtgtattatcacgaatagcatcctgttcgcgcttaaggataatcacaccacccgcatcgccaacgatttggttaccgtgattagattgatgatcccacagcacattttccagactgccgccaaaactgctgctggcaatcatgacggcatcaacatgctgtctgctcaacatgaactgagccagttccagtgccttgaacggggaattttcttctccatagagcgtaaacgccgggccattcaacttcaaatgagccgccagacggcttgctacaatattacctataccgccagtaataccttcaggataaggtttaggaaacagaccatctttgacgatttcctgcaaggctacggtatcttcttctgacagatgaatacctctgctggccaaactctggctaagttgccaactaatttcattacgtgcctgatagcgcaaagagctatagtccacgcctcctgctacaatgacggcgatattgcgcttactgccatccagcgtataacccgcatcaataaaggcacgttccgcgatgggcaacaagaacatatggcagcttaaatgcgcacctaccacattgggcggcaatttgaagtgcttgcagtcaaattcaaacgtttcaatataagagcctaaaggcggctggcttatcccctgcattgccaagacatcgtgacgcttttccatgccaatccagcgggttttcggcagtgggtaaaaatgctgtatcccttgctgcaatgtctgatccagcgttttaccatcttcggttttcgccatatgcacaccaataccgacgatagacagacgctcaattttctgacggttctccaacttcacctgtgtgcatgccgcccgccgttcaggtgtatcttcaccaatgaccatgtgcgcattgaccccaccaaaaccaaaggcgttaatgccggcacgcttaggtctattgctgacaggccagggcttggcttcccgcacgacgtgatcaatgttcagcagccctttttgtgtcaaaaccaattgttcgacacgcggggtagcagggatcatattatgctgcatggccaacagcactttcagtaacccccccatacctgacgcggtgagcatatggccattgatcgctttgttggcaccaatcaatggtattgttccacgttcaccaaagaaggattcaattgtcgagagttcgacctgatcaccaatggtcgtaccggtcgcatgacattcaacataatcaacatgctgcggattatcccgataggcgcgctccagagcgatgcgctgcccctgtatatctggtaccaataagtgtttggcacccgcatcgttggacaacccgatcgattcaatgacaccataaatcttgtcattatcacgtatcgcatcagagtagcgttttatggcaacaatgccgcttccctcacccgctttcacccctttggatgatctgtcaaaaggaatggattccccttttgcagggaatacctgcaacatattgaaaccatgatcgatatagatatggtctgtatgacaaatcgccccgaccagcatcatgtcaaccttgtgactgaagagataatctattcccagtttgatggcatacagtgctgatgcacaggcagcgtcaagacaatagcgaggacccgataatcccagagccaacgctgcaatcgtagcattatgcccacccgtaattaaattctggccagaataatttgcgggtggccaaaccgaatcaaaatgaaaatcagggcgcccaattaatttttgaatataaggctgtaatattttttgataaaaaggactcattaatcgtttggttgaatgagtcggcataccaatattaccgagaattaatccggttttttctaatacttttttattctgacgatagccactgtcattcaatgcctgctccgcagaataaatagtccatttaaataaattatccagcgaatttaattcttcttccggcaagtgatatcctttgccgtcaaaatgaaaatcccggacatgtccattcttaacataattaattgtatccggtttacctgcaaccggagaataataacagtccagatcaacgcccagttccagagcagataagggtgtggtgcaatccttttcccgcagcaagttatcccaatatttctcaagggtatctgcaccgggaaataagcaccccatcccaataatcgcaatattttccatcaaggagagactcctgaatatgacagagttcccctgagcgaaagtattcgctcaggtatattatcaatctgctttctaattataactattaattattttcgctattcaccctgttcgatagttgactgaggaaagataatttcctctattcaacaaacacggtaaattttgcattatgaaaccgactataaatatagccttgttcatcataaaaaataatatctgttattatttccgttgatatttggttcttgatttcaattgacgcgtagaattcttgaccaaatttcaactcagcatattgttctattttttcaattgcattgggtaaacacatttcatttcgttgcagcaaccacattgcaggcaattgaaaagcaatatcgttaatgaacaaattaaataaacgggtcgagaactgcccctgcatttcaagctgtaccggcataacacagcacttcaatgtaatatgatcatcatcaacatggacgactttctggacaccatggaatgattccccatggaacagcatgccctctcccccgacaccgccatagaatggcaacgtctgcggaacctcagcgttcagatcgataccgactgcttcatgcttcgcttcacggctttgcaggctcaggatcaaggtcgcctgataatgtttcattcgtttactggtaatgacaacattcagtgccaaccgcccatcacccgattcatcaaatgtactcggaacccatgccacacagtaagattcagccagcgcgttatcaaagacaatacctttcagaactttgaaatgagtgatggtttccagttgataaccggggaaacgatcttcacagatccgcgccatccaggcaatcgccgccgtcatgggcaatacggatttaccctcgataacatggtgatacaagaacgggttcttatcgagactcaattgacggtcaacctgctctccgatacccaacaccttaactgtcttctcagccttgtagtttgccccgccaatcgtgatctggagtgaaccgggatcccggaactcacgcacaaaacgttgagtgccttcttcgagcggaataatcgccatgttctgtgcgtcatatgcccgtttgagaacatcactgaccataccgccatcccacggtccccagttcactgaacggattatctgactgtttttacctttgaaaggcaggtagataaatttattcagtgtttcgttcgccaacgagtagtcggcctgcccggcattgccaaagaaaccggaaaccgatgagaacaacataatatggtgcagggatgtaaagtctaattcgcggcacagattttccagccctttgaccttggcattaaagaccgaatgtaaatctgccagtgttttcttttcaattcgcttatccgccagattgccggcaccatgaatcagacccgttatctgcccaagttgctgctgtgctttggtcagtacgattttcacctgttttggatcagtgatatcgcagtgcaggtacatgacccgtcccccagcctgtctgattgcctgcaatgtgccattgatttcatcaatatgcgtcaagcggctcaacatcccattaatcttaacgggtgtaagctgaacgccctgcgctttcaggtaagccatggccgcagttttgcgctcatcctgcgtaattttgccttctgcccatttaggcaatggctcggtcatatccgtacgcccaagcagaatgaaagtggcctgactctgtttcgccaattcaataacgcattgtgcagtaatgccgcgagcacctcccgttacaaccagcacatcactcgcgttgacctgattgacagatgtcgctgacaatacattttcttctgtcagtgccaatgtcatacgctcgccattcacgccgcgtcccacttcccccatatcagtccggctatcttggagctcttctaccaccatcttcgccgcatcgctgtctttgactctggcatcaatatcgactgttcggcagaagacatttttccattcaatattcagagacttagtcagccctgtgagcccagccgaaacgatagacaggtgttcccgtccagaggtgagtaactcaccatcaccgcgcatgataaccatgaaataaccggtcttctgttcatcatggttaaggcttccttgcagacgttttgccagcaggaacgtggtttcaactgagcggtaatcctgttcattaaacacatcagctaacgccttaacgctctgcttaggtgtctgcaagtaaataacgccctcaatcgtgccatgttgctgctcaatgtctgccaaagccatgtccagcgctgcttcgtccctcattacagcttggtttttctccagcatcagaacagcaacctgctgtccctgttgcctgagtgcgttcactacgtcatccacggtggttgtcccctcatcaacgaccagccagcgtttaggggatgaaaacaccccctgtagacgatctggcataggcaggggttgtttcaccacggcaaaacgcgaaacgggtgagccggcaaaagactcttcttcatttaagacaatttcattctttagtgcaggctgaaccacagaaggtacaatcagttgcggttcagctaatggcttttttacgctgtcaacctcaggtgaagttactgttgatgtgaaaaatccgagagactgtaatttgcctgttgctcccccgctatcagggacaacgttgcttttggtgtttgcgtgttcacgggtttcgactgatggcagtgattgctctgccacgacttcatcacccccgttgccgagcaagccattcatgacgtcgtcaagcatttgcttaaagaacacgcccatcttgctgatattactcaaggaatcgacttcgaagttttccagatctttatttcttgaagcttcattgtaaagacccacgttcgcagagaacgcgtcaaacatcgcaccaaagatttccagccgcttaatggagtcaatgcccaaatcagcttccagatccatttctggcgtgatcatatcctgcggataacctgttctgtcactgacgatggagatcaattggttgacaatcttctcttcagtgatttgtgacaagagctggaactgtttttctacttcgggatcaaggattttcgcctttgtctcaatcactacaggtgtaggctgactgacaggtgtttcattcactattggcttaacaggttcctctaccactgatggcatgacaggcatttctggcaccattgaacgcactggctcaatttcctttatcgtgtccacaggcttggatccctttacaggagccgtgtcaaccttcaccgctggggcagttgtcggaatcggagttggaattggcgctggcgttgatactggagcaggttctattgtcgccgaagcggtcactttggccagagcggaataatccaccacaggcgatgacgtacggtgagtaggtgctatcatcggtgccacttgcccggactggaacaagctctgctgagccatgaaatagtgttcatggttggaatgatatagttcaaggttcttgtccagtaattgaacactctgactcagactggataacatgctcggcaggttctgatgatccttacaggtttccagcagggtatattgtttatccaacaacatccccagcagttgaatatagtctttctggttagcttgaaattgttggtgaagctggctcatgacctgttgagcctgcaacagtccatttaacatgtttacatctacgttttcactcaactggttgttctgttccatcgtgctctctcgtctttgaatgattgtcagcatattttgttgaataaattgggcagaaattgttttgttttcggcgattttttcgactttattttcaactttttctaccacaacttcttttgttggatgtacttcttgtgttggtttgacttctttgcctgaatgctcttctttgatgttgacttctttttgggaatgcaaaggcataaccggagccatcggtacaggtgcagattcagcgataaattgctcgacaatcgcgctgtcgccatcacgtagcgcacgttggcgtcgtgccttatttttctgggacaggtagaaacccccgctcattctgaacgtcagacgtttgcttttgtcttccgctatcggttgggggcgtatgtgctgatttatttctctgagtttgacaccttccgccagcaatttggcttgagcacgggcaaactgtaaccgatcttcccctttgtcattgggattaacggaaataacctcgtgttctttgtctttcaggatatcggctaccaatttgcccaagacccctttaggccctacttcgacaaacaaccgaccaccctgctggtaaatggcttcaatggtttggcggaattgcactggcttaatcaattgttccgctaacaattcccgaatcgcctgcggagaatttccatacggttccgctgttgcactggagaacagtctgcattgcggtgactggaaattgatacccgccagacgttcacgataaggctgataagccggctggataaatgcggtatggaaagcggctgaaaccggcagaatacggcaatgcacatcacgttttttcaactcatcatggagctggtgaatcagggaagtcgcaccgccgaataccacctgctgctgagagttgtcattggcaatgataatgccggtatagcgttccagaatctgtgcgcgttgtgcagggttgagcgacgcggccagcattacgccagcatcagtatctgccccacggtgatcgctggcagatgccgcagcccagcccctggcaagagaaacgcggtggaaatccttatcggaaagcacccctgccgcccagagtgccgtgacttcaccataactgtgtccggcaacaaaatcaggggcgaatcccatccctttcaaaatgttgaaataacctgcactgatagcgcccaatgctggctgggcattagccgtgtccatcagccgttgttgctgtacctgacgctcgtcatctgaaaatgtcggtacgggataaatcaccggcgatagttcatgccctaattcattgatggacacatcatccagtgtttccagcgattgccgcatttcggggtaatcgttggcaacgtcgcgcgccatgttgacatactgcgacccctgaccggggaacagagcgacaattttgccatccagcatttttccttggggctggtaatagatcccgcgcggatgttcccaaccatgagcgctattctgctgcaactgtttgatggcaatcgacaacaaggcaactgtctgttctgcggattgagagacaaacagcactctggcctgttgcggctgtaagctgtcaatgtcctgctgctcaagatgctggcggatggcgatatcaggcaagttaccactgaaatggatcagagtttcttcacactgcgcaagcaattccgccggattatgacctttaaacaacatgatccaaggtgactcattcagccgataacgtccatgcgtatgtttttcatactcttcgagaatgacatggaaattggtgccaccgaaaccaaaggcactcaatgccgcacgacgcggtgcactgctgaatgaacgcaaccacggcctggcttcgctgttgacataaaacgggctgttttctgctttcagcaagtttgtcggcttacccacattgatagtgggaggcaggactttatgatgcagtgccaacgcgaccttcatcatagacgcagcgcctgcggcacaacgagtatggccgatctgggacttgatgctgccaattgccaccgattttgcaggcacctggtattcaccaaacacagtgtgtaagctttttagttcggtatcatcgcctgatgccgtacccgtgccgtgcgcctcaaccaattgaatatcattgggtgagagccctgcgctggcataagcccgcctcaacgctttggcctgtccttccagacgaggggcaaaaatactcttggctctgccgtcactggaagcttcaatggacttgatgacagcataaattctgtcaccatccagttctgcatcttcgagacgtttcagtaccaacattcccacgccatcaccaagcatcatgccatcagcactctgatcgaaaggacgggataaattactttttgacaatgccggcgttttactgaagcacaggaatgaaaaaatggagttctccaaattgacaccccccgtcaacacggcatcacaactaccagaatgcagttcaccgatagcggccttgattgccgcaaggctgctggcacaggcagcatctaccatataagacgtgccaccgagatcaaaataactggcaatccggccacaggcgacgttacccaaaaaacctgggaaactgtcttcagtccattcaaggtacatgccatgcatccgttcgatgatgtcatttgccactttttctgacaggccggatttgaccataattttacgcaaataaggtgactgctggcgtgaagccagtgaaaatgacgtgttgccatttcctgccccacctaaaatcacaccgatacgatcacggtctaccctgctattttcctgtccaaccaagcccgcatccagcatggcctgtttagcaacatagagtgcaaataactgcgccgtactaattgagtcaataatcgcgggtggaattttgaactccaccggatcgaagtcaatcggaggcacaaagccagcactatggccataagttttatctgccactgccgggttgggatcgtaaaaatcctctttttgccaatattcgtctcctaacatggtagagatatcagtcagcgagtcctttttgccaatgatattttcccagaatttatacaaatttggagcatcaggaaaatgactggccataccaacgatcgctatatccccacgaactttcctatcatgcaaaaaatatgtctcagacatacattcctcgtgtattgaataaaacacgcccgtaatcagcatatatttttatatactgagttgagtgttttcaccgccatactcaaccagaaaaaaatctgtacctacccaatatattctcgatatatgatcgagccatatattagccaaagtagattaccgaaatattcttgtaagaatattacatatatttttctgggatatttttttattctttttttccttagcacagtgtttgaactgttatagctacttttacactgcctgttatagctatttttatactaccatcaacttcaattatctttatctaaaaacaatatgttttctttgatatcgatcagtattcgttgctatttaaaacacaaaggccatcacagaataatataattcattccgaccgattaaaatacgattagtgaaataataacgttcgaaaataaattataacaaaaatcaacaagataataatttaaaactaatataaaaaagttatgtgacaataaacaaaataaaaaaccactaacaaaccatgacaaaaatcttatttttgataataaggagtaaaaaggtaggattaataaaatatgaaacgccagcacacagagggtaatcagtccccatacctgataaaaacctcgataacttcccttaaattcaattaatgctataacattatttaacagggtctgattaaggtgtttcgaagaaaaggccttgatgttatcataaattatttcaacaaaaactctaatgcaaaaaacaaataaaaacaagatcaaataatcaccaatagatggagtgactcgccatatatttatcaggaaaaaataaattccaccaacaatagcagtattaataataatatgccaaatagtattagcataatttatcatggttagacctcttttgaggttaaatacaatcataaagctttttccttgttacaatcttaacaacggtgatcatcttatatgtgtcatttaccatgttacaaaattgattatgaatatcatttggaacataaaattctggcgtttttccttaacgctatattggtatacctttaatttatttttctttcaattctttaaaaaaaccacctgaaacgtatgtattttttgtttttttaaaaaaaacaaacagttaataacaagccattaatatataaaatcgcaattactggtaaactggcaaaaaaaagaatattaaaccattataatacagaagattagttaattattgtcgataatttattttaatagatccgtaagaaaaaatcatactaattgtatgattttataaataattttaatattatattatcatacttatttaatcatacttacctaatcattttcactatgagtgcatcaattaggatcattcagtaatgagcatctgaatctcatgatttgcaattaatgctttaatcatatctattgatttaatttacttagaattcttatttaattaaattcgatactacatataataattttcattttcaatcaccgtaaatagtaaaattttctaatttataaagggcgtttttgaaacagtagactaaactattttattcatttttattcacatacatctattaattagtcagcgataatccgaatattaataagggatatattccaaggtcatcaatcataatgtcgactagagctcatgccgctaacttgtaaaagagacaaataaaaaactcctcgtaaagaggagcttgcatattaaggggtaatgaaaatcattatgtcatcaattttcaggcagttccgtctgtctgttacgcgctagccacaaagaaagggctttcagagaatccggcgtaaattcatcacaacgggcagtaatttcttctggcgacaaccagtaaacagccgaaacttcttcttcctgtaatgcaaacggcccatggctgacacaactgaataaccctccccatgtccggcaggatttttcttcatagtagaagatcccatgttcagcaaaaggcacacccgcgatccccagctcctcttccgcttcccggcgggcagaatcaagcatgttttctcccaccatgaccacgccaccggccgttgcatccaatcttccagggtaaaaatctttcgtttctgtacgatgttgaaccagaattttgcccataccatcatgcacaacaatgtaagtcgcacgatgcctcaagttttggctacgcatctgctggcgagtcgcctgcgcgattacttcattgccttcattgacgatatcaatccactcaatacctactgatttctcttgcaccatcctaaaaaccttaataaacgatttgcatgccagtttctactgtaacgcgcctaattaaaaggccaaaacggataaagattgccataactgaataaaataaatccacgcacagtgaaatgacggatttatggcattttacaggcaactcaaaccagtggtaatgtactggaactatatttatccatccgttattattactagaggttatatgatagacctgtattatgccccaacgccaaacggctataaaatatcattgtttctcgaagaagtcggcctgccttacactgtccattcaatcaatataagcaccggcgaacaattcaaacccgaatttctggccatttcgcctaataataaaattccggcaattgttgatcaccaacccgctgatggaggagaacccatctccatctttgagtcaggcgctattttgctctatctggcgaataaaaccggtcaactgttgagcaaggatgtgcgtgaacgcaatcagcaattgcaatggctattctggcaggttgccggctttggccctatgctcggccaaaatcaccatttcaatcattacgcttctgaagtcgtaccttatgccattaatcgctatatggaagaatcacggcgtttagtcaatgttctgaatacccaactggaaaaaacgccgtatcttggtggaaatgagtacaacatcgccgatatcgctacctatccgtgggctagatgtcatgaacatcaaaaaattaatctgaatgattaccctgcggttgaaaaatggcttgagaaaattgaacaacgccctgcaacacaagccgcatacaacaatggctaatcatgcttactcggctaacgacaaaatttttcaccgaaaaacttgatactgctaacagataacagcatttttcgctgttacgcaggccatcccctgctatagtcaataaccgactatctatttggtcactgggggtggctatgcgtatcttaattactgggggtacggggctgattggttatcgattgacttgccaattactttcgctttcccattccatcaccattttgagtcgttctccacaaaaggtatattctctgttctccgaacaagttgaatgttgggccacactgaaaaataaaaataacctgaatgattttgatgcagtcatcaatcttgcgggtgaacccattgcagataagcgctggacatcagcacaaaaaacaaaactctgccaaagccgctggcaactcactgagaaattaagtcatttgattaatgccagtgaatttccgccttctgtatttatttccggttcctctgttggctattacggcaatcaggggcaagcggtagtctctgaaaatgatcttcctcatgacgaattcgcccatcagctctgtaagcagtgggaaacactggcattacaggcggaaagtgaaaaaacccgagtgtgcctgctgcggacaggcattgtgctggcaaataaaggcggagcgctgaaaaaaatgctgccactgtttcgattgggtttaggcggtaaaatgggtgatgggaagcaatatatgccttggatccacattgatgatatggtcaatggtatctattacctgctggtatcgcctgaactgagcggcccgttcaacatgacagccccttatcctgttcataatgacctgtttagtgcagcactggcgaacgtgctacatcgccccgctttcattcgcatgcctgcctttgtattaaaaataatcatgggagaggctgctatgctggttttaggtggtcagcaggctattcccaaacggttggaagaagggggattcggcttccgctattttgaattagaggaagccttcaaagatttattaaaagcggaagctaattcaccttaaacttcaatttgtttcgctccctgccaacggttgaataaatcttgtggcagttcgatatcaaactgatcgagtactcggttgaccgtctggtcaataatgtcctgaatgtgatcgggacggtgataaaatgccggcacaggcggcataatcaccgccccgatttcagccgcctgagtcattaatctcaaatgccctaaatgcaaaggcgtttccctgacactcaataccagcttgcgcccttccttcaaaacaacatcagcagcacgggtgatcaagccatcagtgtaactatgcacgatacccgacagggtttttatcgagcagggcaagataaccatccctaaggttttaaatgaccctgaagagatagaagcagcgatatcgcggttgtcatgcaccacatcagccagtgcctgcacatcccgcagcgtataatctgtctccagtgccaatgtctgccgggcggattggctgatgaccagatgcgtttcaatgccctcaaccgactgcaagacctgcaataatctgacgccataaatcgcgccacttgctcccgtcagcccgacaatcaatcttttcatgcttccctctgagatattggaaataacttgatgataataaagatgttattacccctcattatatatttccagatcctcaatttcgctctgcccacgcaatttcatggcgtcatctttacgaaggttctccagataatcgaggtaaatctggtcgatatctttcgtaacatagatgccatcaaatacagaacattcgaatttttcaatatcagggttttcttcacgcaccgcattaataagatcgctgagatcctgatatatcagcgcatcagcaccgatgagctggcgaatttcatcaacttctcgaccgtgggcaatcagttcattagcattagacatatctatgccatagacattcgggaagcgaacttccggtgctgccgaagcaaaatagaccttcttagcgccagcttcgcgagctaattccacaatttgttctgatgtcgtaccacgtacgatggaatcatctaccaacaagacatttttaccacggaattcagcacgattggcattcagtttacgacgaaccgatttacggcgttcctgctggccgggcatgataaaggtgcgtcccacataacggtttttgacaaacccctgacggtagggtttatccagaatatgggctatttccagtgcggtatcacaagacgtttcaggaacagggatcacaacatcaatatgcagatcttcccattcgcgggcaattttttcgcccagtttcctgcccattcgtaaccgcgcgttatataccgatattttgtcaataaaggagtcaggacgggcaaaatagacaaattcaaataagcagggcgttaatgcaggattttctgcacactggcgggtaaataactgccctttttcagtgatgtagatcgcttcgccagaagccacatcacgcaggaattcaaaacccaatgtatccagtgccacgctttccgatgcgaccatatattcattgcgcccatcttccagcgtgcgtttccccagaaccagtggccggataccgttcggatcacggaaagccaccaagccatgtccaataatcagggcaacacaggcataagcaccacggattttcttgtgcatcgctgcaaccgccgcaaagatatcatccggctccagtggaaaatccgggaattgggtaagttcatcggcaaaaatattgagcaggatttcagaatctgatgtggtattaacatggcggcgtgcatgttcaaacagcatttttttcaacttatgtgcgtttgtcagattgccgttatgcgctagtgtaataccaaagggagaattcacgtaaaaaggctgcgcttcagaggcgctggaactacccgctgttgggtaacggacgtgtccgattccggtcgttccctgtaaacgcagcatgtgccgtgtctcaaacacgtccttgaccaaaccattggccttgcgtaaacggaactcattgttaccatcaatagttgcaatgcctgctgcatcttgcccacggtgctgaagcaccgttaatgcatcataaatcgactggttaaccggtgtaaaaccgacgataccgacaataccgcacatgtagtttttcctcatcagccaagcggagagggtaatttctccggcaggaaactagacgaattttgcaggtagtcaaaaaaccacctgataatttgactgaactgtgggatgagttgtgactgttgccagtcctcacttttagggagcggtgtgaaagaatctgcaataaatagaatggcagaaacaatcaatactccacgcagtgccccaaaacagatccccagcacccgatcagtacctgacaggcctgttcgctgaacaagtgaaccaatcacatagtttacgaccgcgccaacaatcagtgttgcaatgaataagatagcaatcgctaccccattacgcaccagttcatcttccaagcgggtgaaataaaccgctagataagtatagaagtgacttgcaacaaagaaagcacatccccaagtgaccagtgagagcgcttcgcgaacaaaaccacgtatcaggctaaccagtgccgagaaaccaatgatggcaataattgtataatcaatccagaccatattttaatccaaaacaggctcccgacattcaggtcgggcgcattctaacagaaaacgaaaacgtttgcgtagcagatttctcactctactgaaaataattcgcagcaggttcaaaaacgacaatcgccgcaagggcctaacctgtaactatcacgacgggaagcagaacacttcccgtaagacaccaataaggtcagggactgtagtttttgatttgcccttgcaaacccgtcaattctttcaattcaggcaaattggattcaagggcttgccttgatgcattcggcccgacataaatccgcgtcaatgctccctgtactggagaagaaggaatgatatagacctgatgacccgaaagacgcagcttcgccacaatctcatccactttacccgcattcttcaatgcaccaagctgaacaacatatgccactccctgcggcgccttcactggcgtggatttgctttcagacttagcttcaggattagtttcaggtttggtttcagccctcgtttcccgcttaacttccacctttggctgaggattgggttcagatttaaccgtcgctttgggcgcttgtgtgatctccacaggcggcggtgccattggcgcaggctctgacaataacgaactggacagcatatctggctgtagctcttgtgcttgctttgccatcgcttccgccgccccttccggtggtgtcgatggcatatcctgcgtcaggggtgcgatcaaatcgatatcttcttcatcaccaggctttagtgccagcggaatggaagcaaactggctttcattatgtttcttatcgccgtcaaatagcaccggtaacacaattatacccagtgccacaagaacgatggttccaactaaacgattttgaaatttacttgccaccttccttcacctccgccagtgcctccataacatgagcaacagtatggaaagaaccgcagaccacgatgatatcctgcgctgaggcttctgccatggcctgatgccatgcctgctcaacgtccacaaatgttcgggcatcgccaaggtactcggccagcatggttgcttcggctccacggggttcatgcaatgatgcgcagtaccattcatcaatctgctgggcaagacaagcaagcgtacccactatatccttgtcttccagcataccaacgacaccgcggatcttactgtctggtgcgcggggcaattctgccagcttctctacgagataaccggctgcgtggggattatgcgccacatccaaaatcacccgcgggttttccctgacgatttggaaacgccccggtaactgggccttgcttaacccttcacggatcgctcgttcattaatggcctgactgacgttatcatcctgctgcaacagacagtaaatcactcccatcgctgttgcagcgttcgccagaggcagattggggacgggtaattcactgaactgttgatctcctgtgcgccagtaccaactgtccgcatcctgtgagaaatcccagtcaacaccgcgacgaaataatttcgaccccagctcatcagccacttcagcgatggtatgtggcatatccggctcccccaccacggcaaaacgcccctgacggaaaatacctgctttttcacggccaatatgttcgcgatccgcacccagccaatcgatatgatcgagtgcaatgctggtgattgccgcaacatctgaatccacaatattggtcgcatccagacgcccgcccagccccacttcgagaatcacgacatccagatcagcttctttaaaaagctgtaacgcagccaaagtgccgtattcaaaataggttaatgtgatatcaccacgttgggcttcaatgtccgcaaatacacggcagaaatcctgttccgtcggctctttaccctgtatacgtacccgttcggtataacgcaccagatgcggggagctatacactccgaccttcaggcctgcggccagtagaatggattcaagggtatgacaagtcgtccccttaccattcgtgccggacacggtgatgactttcggcgccggatgcagcaaatctaactgatcggcgagtgctcccacacgttcaagccccatatcaatggcttttgcgtgcaggtttccgagataggaaagccacgtcatcagtgacgacgtggcttgaggaatttgcaatatatcagacatcttctttattagtattgatgtttatgtcagtttcaacatcagcgggttcagcaaccatctccgctaccgtttctacttttgcagcgggatgaggctgacgagtcaacatcgaaagcaaattggctattttctcacgcatttctggacggcgtacaatcatgtcaattgcgcctttttccagcaggaactcactgcgttggaagcctgccggcaatttttcacgcacggtctgttcaatgacacgagggccagcaaacccaatcaatgccttaggctcagcaatgttgatatcacccagcattcccagacttgctgtcactccgcccatggtcgggttggtcagaacacagatataaggtaggccacgatcttgcattttcgccagcgcggcactggtttttgccatctgcatcaaagacatcagcgcttcctgcatccgtgcgccaccactggaagtaaaacagacgaatgggcagttgtcttccagtgactgttcgacagcgcggacaaagcgcgcaccgactacagagcccatggagccacccataaaggtaaattcaaatgctcctgccacaattggcattttgtacaatgagcctttcatcacgatcagcgcatctttttcctgcgtctgcttctgagctgctaccaaacgatctttgtattttttagtgtcgcggaatttcagcagatctttaggttccagttcactgcctaattcgataccggttccttcatccagaaatgtgtgcaatcgctcacgggctgaaattcgcatgtggtgatcacacttcgggcacacttcaaggttacgctctaattcagcacgataaagtacctgaccacaactatcacattttgtccaaactccctcaggtatacttgccttacgagtttgcattattttgcttttatttagaatcttttcaatccagctcattaatgaacctttccgtctgattctggcctatgccagcttttgttttacgtgccattaaaccacaatgccattacagagtggataaaaaactgttcaaacttactaacggttatctacttgccatctactgcttttttggatgcagctcgtcgatggcgccaaatttcaatgatgccaggcaggatagaaataaagataattacaacaatcaataatttcaggttctgctgtatgattggcatatcaccgaataaataaccggcataagtgaataatagcacccatataaatgcaccgattacattataagcagcaaaatggcggtaagacattttccccattcccgcaacgaacggtgcaaatgttctaacaattggcacaaatcgtgccagaatgatcgcttttccaccgtgtttttcataaaactcatgggttttatccaaataactgcggcggaaaatctttgaattcgggttggtaaataatttttcaccaaaaatacgaccaattgtatagtttacagcgtcaccaataatcgccgctgtaatcatcaacgccaccataatatgtacattcagatcattggagcctaatgcagacaacgcgcctgccacaaacagcagcgaatctcccggcaaaaatggcgtgaccaccaaacccgtttcacaaaatatgatcaggaataagatgccatatacccaattgccataatcactgaccaattccttcaaatgtgcatcaatgtgtaaaataaaatcgacaatgaacttagtaaaatcaacaaaatgagttaaaaactccataatattcctcgttatgctcgaacatccctgtcacattttgaaaatgtcagattaaatcattagctagaaacaacggccccataatgggttcaggtaaaccaaagtgctcaggataatccaccgcaactaaatataatccctcagctttagctgttgccgccgcttttgttctgtttttcagtgccaatagttcagccatccagccgatatcctgattactacaaccaatttccagcaaactgccaacaatattacgcaccatgtgatgaacaaatgcattcgctttaatgtccaccaccacataatgcccatgccggctgacattaatgtgcatcatattgcgccacggtgaattagattggcactgtactgccctgaaagaagtaaaatcattctctcccagtaaactctgtgccgcttcatgcatttttctctcatccaatggatagtgaaaatgcgtgacgccctgtgctaacaccgcagggcgatagcgatgattaaagattatatatcgatagcggcgtgccgttgcgctgaaacgggcatgaaattcatcatccaccgtttttacccagcgcactgcgatatcgggtggcaaatggctactaacgcccattgtccaggcagcatctttacgttgtgccgaggttttaaaatgcactacctgcccagtagcatgtacccccgcatctgttctgcctgcacagaaaaccgaaatcggttcatctgccacttttgacagggctttttccagacattcctgtacactttttacttcttgctggcgctgccaaccataatagcggctgccatcatattcaatccccagtgcaattttcactttttttgcctctggtacagactgactcagctctgcatcagacatcagtagaattgctcctgcatcagtttttctgcgatttcaaccgccatcagcgcaccgccaaaacggatattgtcggcaacagaccagaattgtagcatctccggcataccgtaatcattacgcagacagccaatactcaacctgtcattgccggatgcatccgtgacctgagtggggtaatccccctcttctgagacctgaatttccgcaaaacgttcaagttctccacgagcttctcctacaccgactggacgcagcgtttccacactcaccatctgggcaattccgtagaaaaccgaagattgaacacaactgactgaaatgggcagcccttcgtcctgtaatattctgcgaatttgatcgacaatgcgacgctcttcgcgtactgagccttcggcatcaggcaataaaggcagcaagttgaaagccaattgtttgttaaaaagactttcatccggcggaatgccgctcaataaacgggcactttgccctgccaattcattaatggcggctttaccatgtacggaaaccggcaatatattggtcagatttatacgtgcaacacctgcaacatcgatcaatggcttaatggccgtcaaaacctggcttgttgagctgtccgccacagcaatgatgttgcggttgcgatattcagccaaagcgtatgggttaactcccggtacgaccagcggtacatcgggctctgcggcaaacaatccgctgctgtcaattaccagacagcccgcttccgttgccttttcaacatattgtgccgttgcttccatcgtcgcggcaaaaaacgcaagctgtacctgtgaccaatcaaattctgcggcatcataaacggtgatgcttttaccgctaaaacgctgaattttcccagcattttgctcactggcaagaagatgcagttcaccaaccggaaactcgcgctcctgtaataacgccaatatcgcttcacctactgcgcctgttgcacccaagagcgcaatattccagccttctgacatgttggttttctccacttcttttattttgctgacaggcaggaacacctgcctgtattaaatcactttagcgttaaacccaatttcagacagtaattgggcgcttttttctgagtcacaatgcaccgtcagggaagaccattcccggcgctctggatagtttttacgcaatcggtcaaaagcgccatcctgttcagcgacctgacgtagtggtgcatcatcacggcgcacatcatacactaaatgtatcaagcgcttcaggatgctttgtgtcacttcaccatgtacggtgatatggctgaaatcaggttcaggcaaaaggtcggacaattccgccctgcgcggctgccccagaaattcgcagtaagcctcaaagacctgagtcgtaccacgtgctttgccttccagagtgtacccggcaatatggggtgtaccgatatcaaccaaagccagcaagggtaatgaaaggttaggctctggttcccagacatcaagcacaacacgtaattttttcccactttgtaatactgaaagtagtgcttgattatcaaccacttcaccacggctggcattaatcaaaattcggttgtccggtaatgcagaaagtaattctgcatcggccagatgataagtctgataacggccagatctattaagcggagtatggaaagtcagaatatccgcttcctgtactaatttttccaacggccagaattcaccctcatccccacgatcggcacgaggaggatcgcacagtaaggttttcacgcccaaagcagccagccggtcagccagacgccccccgacattacccacaccgacaatgccgacagttttatctttgagttgaaattgatcccgttccgccaataacatcagtgcagaaaacacatactcaacaacggcaatcgcattgcatcctggcgcggctgagaagccaattcctgcctgcgacaaccattgctgatcaacatgatccattcccgcagtagcagtacccacaaatttaacagaactgcctttcaacaaggattcattcactttagtgacagaacgcaccataaaggcatcagcctgttccagaacacccgcagggactgggcgccccggaattgcctgtacttcgcccaattgctgaaaaagttgttcagcgtaaggcatattttcatcaaccagaattttcacttttctcatccaacgacttaaatgggcgtgatccactattctgccacttaatcgacataaaacctattatcagaaatgggagaattatctggattgctacatctgttgtctgattatcactatatacaaaaaatgggtcattgttacactaaatacactatgcacttacatgaataaattaattcaatgataaatttcttgtttccctttattgccgttctgatttggtcaattaatgccgttgtcagtaaagtagcagccacgtcaattgagcctgctgccattgctttttatcgttggttcattgcgtttctggctttaacccctttcattttatggccggtcctgaaacagcggaaaatggttatccagtattggtggaaattattgattctgggtactctgggcatggtacttaaccaaagtatggcctattacgctgcccatacggtgagtgcaacattgatagggatctttacttcactgattccgttgttgacggttatcatcagtatctttgccttacgggttgcccccacggtaggtatcaccctgggtaccgtgttttcgttgttcggcttggtatggctggtgagcaaaggagagcctgcttccttattagagcacggtctggggatcggtgaagtgatgttatttattgcgtccgcttcctacgccttatatggcgtattaacaaaacgttgggcgatcccattacccaattggcaatcactctatatacaaatcgggtttagccttttgctgcttttgcctaatttcatgatgaccgaagatgtccggttaaccagcgataacatttccctcgtcctgttcgcgggcattcccgcctcaattcttgcgccctatctgtggatacagggcgtgactcgcctgggcgcgaatatgacttctatatttatgaatctggctcctgtatttaccgccattatcgccatagtgtttctgcatgagaaaatgcaaagctatcatctgatcggcggcggcattgttctggcaggggttatactcgcccagcgcctacgtacccctctcactcgccggaagtctgaataaaattctcaccagcaaaccgcccagtgttgcactgggcaaaagctggagagtcgcaccgtggtacaagctgatatctttgacaatagtcagacccaatccagcgccttccagccccgctgcattgtccagacggttaaacgccatcagcgattgagtaatattttcttgcgcgatgcccggccctgaatcatcaacttcgaggcaacagtattttttgtccgctgtcatgctcactcttgccgtcaccattcccgcagcaggcgtatatttaatggcattatctaacaaattagcgcacatttctgtcaacaatactggttcccctttgatccaaaaggcattttccccttcataacccaaatcaacatttttgctttccgcctgttgcaaacgagaaaaacaggcttgctgtaataattccacaatattgacgggctgataattctggatggcttctttctcatgcactttcaactgtgaaagatataacaaacgatcggtcagtgagatcatgttatctacggtcttgttgatagccttgatgatttttccactcggatggggatctttgtcattgagtgccacggctatctgcgtttttaatacactcaaaggtgtcctgagttgatgagaagcatcggcactgaaccgcgcttgacgcccaaccatcagtttcaaccgttctatgtagcgattaaatgcccgaagcaatggtgaaagctctgaccacggcaaaatatccggcaatggggttaagtcattggctgaacggagcaccatcatgcctgataacctgcgcagtggtttaagaagctgctttaacaggaaataagcaagaatcagtgtcaataccactacggttccctggcttatcagggaagaaatcagtaattgccgcgctaaatattggcgggaacccacggtttcagccaccagtatcaatgccatgcccattaaccccccttcgttgatcggctgatacaaggccgcaacacggatggggtatccctgatattccgcgttataaaaatataccaaggccgtatacagttgtgaacgctgggtatattgaggaatggggggtaaattatcgtaaccggaaatggttttcccttccggtgatatcacttgatagtagagacgatcattggtattacgttcaaaactgtccaaaacgatataaggcacatcaacgtttaactgtttattctttactgtcagacgttccgcaactgttcttgccgatgcaagtaacgtccggtcataggcaagtgttgccgcattttccgcactgaaataatgggtatacacagaagccccgcccaataacaacagtggcgcaccaaagaacaggagtaactgatgaaacaacgagcgtggtactttgaacagtttcattatttctgcaactccaatcgatatcccaatccacgcaatgtacatattcctatatcactgttgaggagctttttccgtaaccgatgcacatacagttcgatgctttggggatttgcttcatcggataaagaaaatacctgctcaaacagttgttgtttcgaaaccgggcgcccacgacggtgaaaaagggttgttaaaactgagaattctctgggagtcaacgccagcggttgattatccaataagaaataacctgcgtcttcgtaagccaatgagccgaattgctgcatccctagcggcgagccaacaccacggcgtaacagtgctcgaatacgggcttctaattcttcaaaatcaaaaggtttagttaagtagtcatcagcgcccgaatttaaccctttcactcggtctgcaacatccgctttggcagtcaataacaaaactggcaaattttgcccgcgcttacgcagccgtgataacagggaaatcccatccagtctgggtaaagcgacatccagaatcagcaaggtataattttccgtcagcaaaagctgatctgccgcaattccatcttcggcaatatcaaccgtaaaaccagaacttcttaatgctttctgcaaccaatgtgataaatcagggtgatcctcaactaataaaagacgcatttaaatatatcctattgttttaattttaatagaaatttcatccatgttgcctggaaaattatcccattctgtacgcattttttatgcctaaacccaaagacaaccatgaagataatggtaggatgctacacaattgcaatattcagattgagtaattgttaatgggataacataaaatgggaaccctctcgcaaaatattattcttattgggataagtgatttagtcggacagtttacgattcatctgaaatgctaaggtcgtctgattaaataatggaatacacctcgaatctttaagcagagcggcttctaatttgataaattgcatagtaagatgaggaataatttagtattaataaaaaatcagcatatacttatcgaaataaattaatgtaacctaggataacaatatggaaaatttatagtttaaaattttatttctctaaaacaagtgaaaattaaataagatcaacgcatccagattaaaataaaaaattcaaaaaaagcagaataaatattgatataaaatcaattccacatgaagccgatataaaaataatttaactaaataaaattcatttaatttatggctaataatcctgattttattttttataatcaggattatttaagccaaatattttttaatatacttgtaactataataaaatccatcacaataatgagagaacttccccctccgtgtaatgtgaaacactacgaaaattaagtgactaaagtcacattcagatactttttattgttaatgaaaggtaaatgaaaggtttcgcatttataaataaaatgctcctgatatttgtcaacttattctctttgctggagctatgtgaggaatcaaaatgaaaaaattcaatatgttattagcaactacctgcttacttttctgtgccaataccttagcaaccaatgcccctaatagaaccgaatgcattgcaccagccaaacccggtggtggctttgatttaacctgtaagttagttcaggtttcattattggatagcaaagccatcaatacgcctatgcgggtgactttcatgcccggtggtgtcggtgctgttgcctataacgccatcgttgctcaacgttctgctgagcccggaactatcgtagctttttctggcggttctctgctgaatctttcccaagggaaatttggccgttacaacgtgaatgatgtgcgctggctggcaagcgtcggtactgactacggtatgatcgccgttcgtagtgattcgccttacaagaacttgcaagacctcatggaggcattcaaaaaaaatcctaccagcattgtattcggtgcaggtgcatccatcggcagccaggattggatgaaaacagcattactggcgaaagaggttgggattgatccacgcaaaatgcgctatgtcgcgtttgaagggggtggcgaacccatcactgccctacttggtaatcatattcaggtcgtttccggcgatctgagtgaaactctgccttatctcagtggtgataaaattcgtgttcttgcggtctatgctgataaacgcctgagtggtaatttagcacgtattccaacagccaaagagcagggttataacctcgtctggccaattattcgcggtttttacatagggcctaaagtcactgatgaacactaccaatggtgggtagagacatttaacaaactacaacaaacaaaagagttcaaaaagcaacgcgagctacgtgggctctttgaattcaacatgactggcaaggaattgaacgactatgtgaaaaaacaagttgcccaataccatgagctggccaaatcctttggtttagcaaaataacaggagtgtcaccatgagcgatcgtatatttgccactgtatggttggtactgtgtgggatcgggctaaccattggctggggcattcacagtgaatacagctatgaacccttaggaccccgaccatttccaatcgccattatttcgttaatggcactctgttctttgttactgctattcaaaaaacctgagcccacccagtggcctacagcacaagtattacgccgcttactgttgttgattacctcactagtcgtttatgcatggacatttgagtggctgggctttcctctggcaacgacgttactaaccatcagtgtggcgttactgtttaacgctaaacttcctgcggcgatcatttccggcgtgtttcttggtgtctcgctcttttttgcatttgatcgcctgttagatgtcactttgccactcggcaattggctaaaataaggagaatgtaaatgatggatacttggatatatctgagtcagggttttgaagtcgcattaatgcccaaaaacttagtcattgcgttaatcggctgttttattggtactgttgtcggcatgctccccggccttggcccaatcaatggtgtggctatcttgctaccattggcttttgcattgaaattacctgcggaatccgccttaattttattggcaacggtctatattggctgtgaatatgggggccgaatttcttcaattctgctgaatctgccaggagatgccgctgcgattatgacagcgcttgatggtcatccgatggcaaaacaaggaaaagccggtgttgctctctctatttctgcggtcagttcgttttgtggctcacttttagccattattggaattatcctgttcgcgcctattctggcaaagtggtctttggcatttgggccagccgaatattttgccctgatggtttttgctatcgcctgtctcggcagcatgatgagccagaatcctatcaagtctttactcgccgccttaatcggtttgagcttggctacagtcggagtcgatgccaataccggggtttatcgtttcacctttgatagcgtccatctctctgatggcattcaatttattgtcgtcgttattggcctgttttcagtcagtgaaattctgttgatgctggagagcacctctgcgggacaaaaagtgataagtaaaaccggacgcctgcttttcaataaaaaagaagccgcagtttgtacagggccaatactacgctcctcagtgattgggttcttcgtgggtatcctgcccggtgctggggcaacgattgccagcgcaatcacctatatgacggaaaaacggatcagcgggaatagcgactcctttggcaaaggtgatattcgtggtgtggcggccccagaagctgctaataatgcttcagcatgtggttcattcattcccatgctcaccctcggtgtacccggttcagggacaacggccgtcatgataggtgctctgaccctctataacatcacccccggccccgccatgttcacagagcaaccggatatcgtctggggactcattgccgccttactgatcgccaacgttctattgctgatcatgaatatcccgatgattgggttatttacccgtatgttgaatattcccttgtggtttttagtccccgccattgccatcgtgtcagcagtcggggtttatgccgtacacagtacgacattcgatcttatgctgatggttggattgggcgtttttggttatatcctcagaaaaatgaatttcccgatgtcaccgcttattttgggatttgtattaggtgaaatgctggagcaaaacctgagacgcgcactatcaatcagtaacggaaatttcgagatcctctggagcagcaccattgcccaaactttactggtactcggtgcattagtgattattattccacctgttttacggataatgaataaacgccgtaataaaaacacggccgcataaattaaaatagccaatccatctaatcaatggattggctttcattttaactaatgaattttttcagtcgtcagaaaatcagttcgaatatttacgcatcaccagggacgcatttgtaccgccgaacccgaagctattggacatcactgttcttagctcgcgtttggtaggttcagtgataatattcatacctgacgcattctcatccaagttatcaatattaatacttggcgcaataatgccatgttccagcattaatagactgtaaattgcttcgtgcgcaccagccgcccccaaagagtgccccgtcatcgctttggtggccgaaatagcaggggtgttgtcaccaaacacttcgcggatagctcccaactctttcaagtcaccaatcggggtcgatgttccgtgggtattgatgtaatccacgccaccttcaataccgtcgagagctagcttcatgcagcgaacagctccctcaccagaaggtgcgaccatatctgcgccatcagaatttgccccataaccgatgatttcagcatatatatgtgcgccacgagctaatgcgtgctctaattcttcaaccacaacgataccgccaccgccagcaatgacaaaaccgtcacgcccctgatcataagtgcgggaagcgagttctggtgtttcgttatatttagtagaaagcgctcccatcgcatcaaattcacaggccatttcccagctcagttcttcaccgccgccggcaaaaataacatcctgcttaccaagctggatcaattcaactgcgtggccaatacaatgtgcagaagtcgaacaggcagaactaatggaatagttcacccctttgattttaaatggtgttgccaggcaggctgatacaccagaagccattgcccgcgtcaccatataaggcccaacgccacgcagccctttggctcgcataccatccgatccattaacctgattacgtggagaaccgccacctgaacccacaaccagaccagtgcgcaaattggaaacttgctcatcagacaaaccagaatctttaatcgcttcatccattgcaagataagcataaatagatgaatcgctcataaaacgctgagttttacgatcaatgagacctgatatatccagttttatattaccccaaacgtggctacgaagccccatctctttgaattcttcagaaaaagttatcccggaacggccttctctcagagactccagcacctctttctggttattaccaatactggaaacaatccccagaccagtgattactgcacgtttcattcattacctcatcatttttacctgcgggatttctgccccgcactttagcgtacacttgtacgccgaacaagtccgatcaggttaaaaattcacggaaaagttgatctggactcaagtgttaacttttctcacgggtggtacaacagtatgaacaccgttaaaatctcatattattcttgtcaaccatacaggcattattgtgaaaaacagtgctatcagcagcgcaaccctaaactggaatgaacagggtacacccgtttctgagcagtttgatgatgtttatttttcaaatcaagatggcttggaagaaactttatatgtatttttaaaaggtaatcattttccccaacgttttaatacgcactcccgccctgattgtattattgccgaaactggattcggtactggattgaatttcctgacactttgtcgagctttttcaatctttagacaacaacatcctgatgcatctttaaaacggcttcattacatcagttttgaaaaatacccattaacgacagcagacttgaagactgcgcatcagcgctggccagaacttcaaatattttctgaagagttatgtcagcaatggcctttacctcttgggggctgccacaggctaatgctgaataatggcgctgtcacactggatctctggtttggtgacgtaaatgatctattaccgaggataaattcgaatctaactggaaaaattgatgcttggtttttagatggttttgcaccatccaaaaacccgcagatgtggagcgaacaactgttcactgcaatggcaagattttctcgtccagaaggaacatttgcgacatttacgtcagctggagtcgttcgacgtggattgcagggagccggatttgatgtcaagaaaataaaaggctttggacacaaaagagagatgctgacaggggttctagctccatcagcacattcccctctttcctcatcaggtactccatggtttgctcgacaagcagctaccgataccgatgatatcgctatcattggtggcggcatcgccagtgtattaactgcacttgccctattacgccggggcgcgaaagttacactgtattgccaagataaccaacccgcacaaaatgcatcaggcaatcagcagggagccatttacccgttgctgaatggccgtgacgacttactggaacgtttctttatctccgcctttacctttgcccgccgtcaatatgatcagctaattgatgaaaatgtttcctttgattatcaatggtgcggtgtcagccagttggcttacgatgaaaaaagtgacaaaaaaattgccaagatgctgcaaacatcgtggttagaagagattgcaattggaatggatcgccagcaattgagccaagcgagtggattagatgttaattatcatggtatccactatccacagggaggatggttatctccggctcaattgactcaggaggccatcaatctggcagaacagcgtggaatgctcacctatttcaaccacaaaataactcaattagttcaagatgaatacggttggcagttgcatattgagcaccaggggcaatcgctgcacaaaaaccacaaagtcgttatcattgctaatggacactgcctgccgcaatttacacaaactgaaaaacttcccgttactgctgctcgtggacaagtcagccatatcccgacctctacccgtctcagccaactgaacaacgtactgtgttacgatggctatctgactcctgttaatcctcacaatcaacatcattgtatcggtgccagctatcagcgagggaaagttgatactcagtattcttccgcagaacaacaagaaaatcgtgatcgtttattgaaatctttacccgatgtcgattgggtgaaacaggtcaatatttcagaagcgaaatcccgtcaaggtatacgatgtgttactcgggatcatatgccgatggttggcaatgtgcctattttcagtgaaattatggccaaatatgccggtttatctcaacggataaacactgatgagacaattgaagaatctccttgttatcctgatttatttgtcattggtgcattgggttcccgtggattatgttctgctccgttgagcgcagaattactcgcagggcagatttttggtgaagctctgccacttgatgatgaaacattggcgaccttgcatccaaaccgattctgggtcagaaaactattacgaggcaaagaagttaaagctggaaagccataaatcacacactataaaatcatatatctgcatcaggcacagtgaaacagtgtttgatgcagagtaacaacccgcagtctctattctcaaaactcaatcgtgataatctgttgtaacaaccaaacgcttcatcgcacagcgttgattttctgcaaacccatattcaatttcacgttgcaggatctgacacaaagcaccagtaatttgccgaggttctaagataaaaaaccccagtcgctgataaaatggggcgttccagtttatatgacgcaaagttgtcaacgtgacagcctgaaagccgcgctgttcagcaacctgaataacggtatcaatcaacgcttttcctatacctttcttctgccaatccccatgcaccgagagttccataatatgtaagccatcatccaacggttttgccagaataaaaccaacaggctgattatcgccattcagggcaatccaactattctgttgcgaaatataatctaaatgctgctgttccgtgtggacattgccattagcaatccatgccaattcaggtgtcgagagaaatagctgacccgctgatcgttctattgctggtaatactccggcatctaatatctgtgttggacgaataaaaaacatgtcttaccctcagtctgttaaagacatttatcaaatccactaatactaatgataaaaagagtaaataaataattaatttatcattgtgataattcaaatcataaatttcatagctgcaataacgatcccagagaaaccaaacatcattgtcaccatccatttggtttgatccgccattttcttatatatcaatgatatttctttatgaatagccgcagtgtttttatgccctgatgctatttccttatgtatagaagatatatctttgtgtatagaagatatttcctttcgcatcaaggacatttctttatttacagttgttatttcttgatgaataatgtttttaactgacgaaatctcgttatgaataatactcttaaccgatgaaatatcgttatgaactaacaccttaacagattcaatatcggcttttgttgcatagttggattttatcactgacacatccgtttttaactgggcaacatccgactccaggttttctactcttttttcaatttgttcacccatatctcttctttctatctctgttgactggctgaaattaacgggtttagataataaaaatgcagctttacctacagcatagcccttcccaatattaacggagtgagttgcctgcttcatcctatcacctcctgaaatatctgttttcggtttggtttatcgacagacacaccttatgcgtttaatatcttagtcaatctattcttactctattatttatcaaagcatatacttcattgccgcaataattatcccgctaaaaccaaccatcatcgtcatcatccatttagtttgatccgctattgtcttatatatcttcgatacctccttatgaatagatgacatttctttgcgcaccgatgaaatctcgttatgaactaacgccttgacagattcaatatcggccttcgtcgcatagttggattttatcactgccacatccgtttttaactgggcaacatccgactccaggttttccactcttttttcgaatttactaaatcttacatccatagcaatgccctatttataggtttaagttacctaatcagctaatgaaatgttccattcccatcatctcatcacaacaatttagcattactgttcttataaatcatcactgattcaactaatatccatctactttttcttccttaaccaatatttttcatccactcattaaaaaacaatatatttttatactatattaaagacatatagaaaataacccctaccaatcacaaagaataattaattaaaacaaaatatacattattaacatttttaatggctataggttataactctaattattttaattcctaagtaaataaaaattcattctattctgataactaactttagaaaatatttatatatatcctgataactttaatatcttgttttatttaatcttaaaaaaacaaataaatattcccatctctctattttttataattattttatgagttttgtgaaacattacgcatttctttgtaattagaaataataattacaccgacataacagaaaaaataaaggggctatatgaataaccccaaatacaagttatttataatcaattaattagtctttcgcactatccagtagcctttgccatgtcgataaaactaaaacctgatctggtggagccagctctcctgccttgatagccctatggatgctctcttcaacactctgatggagctgttcaatagtattagcaccttctagttccaactcagcaacagccaatgtcagatgcccacggagatatccaccagcaaataattcgtcatcactggcatcttcaaccctgtcatctatatgtgccagaatgcgtgtttcaaactctgcgagcattatgtttcctcaaaatcaaatatcagttagcaaaaggatcttccggacaaggaaagtgttctgctgttagtgggggcgtattgtagaacgagtgtagtccttgaataaagcgcgctgctcgtgtgggtattccgttttcaaggtatgtgataacttgcgcatggactttacactgaaaagcaaaacgatccggctcgcaatccccttcaagattgtcacaactgacgttgaaaggaaaacccgctgccatacagaataaccattccaacgcctgtggtttgatttcgacttgctcaaattcagactgagtttgagcatcacgcccatcagggcagtaccagtaaccaaaatcgacccgtttgcggcgctctttacccgcaatgcaccaatgcgatatttcatgcaaaccactggcataaaaaccatgggcaaacactatccggttgtagccaacttgatcatctacgggcagataaatcggctcatcatcaccttttatcaaacgtgtattacagtcatcgctaaagcaattgtcaaaaatttcaatgagttgttggtagtgatgtacagtcatgtattaatgcaatatcctaaaatcaaaaataaaatgccaaccaagagcggatagtatctccatgatgatcatggagtagtttgatactcatcaaaaaagaaatcgttaccagcatcggacggatcagtttttgccctcggctcagtactaaccccgcccctaaccgagcaccaatcacctgccccatcagcatcacaagacccaatagccataagacctgcccaccaagaataaaaaagcccagtgaacccatattggatgcaaaattcagcaccttcgcatgtgccgtcgctttcgccagattgtaaccacagagcatcacataagacagtgccagaaaggagcctgtccccggcccaaataccccatcgtaaaagccaattccgcctccggcaagacagccaaatgccaaaggcgccaagcggcgcggccgatcttcagcaccaatattcggcaccagcagaaaataaagaccaatgataatgaccagaaccggtaagagataaagcagaaaatctggggatacaaattgaaccagcaatgcccccagcatggccccaaacagagtcatcgctatcgcaaaacgttgggagcgccaatctactgctccacggcgaataaaataaagactggcggagaaggagccaccaaccgcctgaagtttattcgtcgccagcgcctgaacaggagaaacaccgactgacagtaaggctggaatggtcaacaacccaccccctcctgcaatagaatcgataaacccagcaactatcgcaaccaaaaacaggaaaccgtagatttccggacttaataatgaccattccatgatttatttcaccagaaaactgcttatcaataatccagatgcttgtatttcagacgttctcttaccgatttaccagcgtggcagtggagagatgacatcagcacattgcgcccgctgacgcagtaagtgatccatcagtacaatcgccatcatcgcttctgcaatcggtacggcacgtatccctacgcagggatcgtggcgaccacgggtcaccatatcgacttcttcaccttggcggttaatggttttgccagacaccataatactagacgtcggtttcagagcgatatgagcgataatcggctggctgctactgatcccacccagaatgccgccagcatgattactggtgaatccctgggaggtaatttcgtctcggttttcactaccgcgcaagttaacaacaccgaaaccgtcaccgatttcaacgcctttcactgcattaatgctcatcaaggcgtgggcgatgtctgcatccagacggtcaaaaataggctcacccaacccgacaggcacattctcggcaacaagggtcactttggcaccaatagagtcaccttcttttttcagggttcgcaataattcatcaagctgggtcaatttactttcatcagggcagaaaaaaggattctgttcaacgagatcccaatctttcaattcgcaatgaatatcccccatctgagtcaggcaagcacgaatgcggataccgtgtttttcgagcagatattttttggcaattgcgccagccgcaacgcgcatcgctgtttcacgggcagaagaacgcccgccaccacgataatcgcgcagcccatatttctgttcgtaggtataatcagcatgtcccggacggaaaacatctttaatcgcactgtaatcctgtgagcgctgatcggtgttttcaatcattaggccaatgctggtgcccgttgttacgccttcaaagacacctgaaagaatacggacttgatcaggttcgcggcgctgtgtcgtataacgagaggttcccggacgtcgcctgtccaaatcgatttgcagatcagcttcagtgatggcaattcctggaggaacgccatcgacaatacatcccaatgcaatcccgtgagattcaccgaatgtggtaacacggaaaaattgcccaatactatttccagccatccctaccctgccatcaattaattatgcgttaaagattagattaattaacaataactcactcaatgattaaaacctatcttattccggcacttttatttgcctttaatttaatcaagaacagccttactcattgagtgtcatgaaaaaatattaatctttgaacaggcgaaaatattcgtgatgttcgattaattgctcgcgtgtcagcataaagacaccatcgccaccgttttcgaattccagccatgtaaatggcacgccaagatattgatcaattagatgcaccatgctgttacccacttcacagatcagcaccccttcttcggtcaggaaatccggcgcattcgcgagaatacgacgagccagtgtcaacccatcaactcccgcagccagtcccaattcaggttcacggaggaattcatccggcagatcgttcatgtcttcttcgtccacataaggaggattagtgacaatcagatcgtatttcatcggtggcatatcacggaataaatcagacaggataggaataacgcgattcaaaagcccatgattttcaatattctgttcagtcactgccaacgcatcgcctgaaacgtcaacggcatcaacttcggcttcagggaattcatgtgcgcaggcaatcgcgatacagccacttccggtacacagatccaaaatggtagatggctcctgtggaagcaatcctgcaaattggttgttaactaattcaccaatcggtgaacgaggaaccagcacgcgttcatcaacataaaattcatggccgcagaaccaggcccggttagtcaggtaggcaaccggaatacgttcattaatacgacgcagaacacgttctacgatacgatggcgctcggtagaggtcagacgagctgccatcatggattcaggaacgtccagaggcaggtgcaatgttggcagaaccaactgcaaagcctcatcccacgaattgtctgttccatgaccgtaatagatattggcagcattaaaacggctggctgaccagcgcagcatatccagaatggtatgcagctccgcgactgcctcatccacaaaaattttatccacaagcatctccaagccacaaaaatgtattagcgcgtattttgccatgatccctgccacaaatcagctatctgagcatgggaattatgtcagtgaataatgagcctatctcagtgagtatctatgttacagccagtttgtacacaaagagtacgcaaaaaagtaaatagaatggcctactgggagagtctaataaagtgcaatttttttctggagagggtaagagaaccaccctgtattcacagggtggtatgtttgggcgttatctcgtttttttcacccacaactttttcacccacaagaaataactaagggtgagtaatgctatccatgctatcccgacgtacagtgcgatacgggtactggggaaatatcccaacacgacgataataaatgccatgaatgaaatcgtcagaataggtgctgtaggccaaaggggaacggggaattttagctttttgacctcttccgccggcatttttcggcgcatgatatattgtgacaacaaaatcatcagccatacccacaccgttgcaaatgtcgcgatggaagcaataatgccaaacactttttcaggcaacaggtaattcagaacgacaccgattagcagtacacacgacatcaccagcacagtaacccacggtacgccgtttttggttaatttcgtgaaggctgagggcgcttgtttctcttgtgccatgccatacatcatccgtcctgagccgaagatatcactgttgatcgctgaaatcgccgcagtaattacgacaacattcagaatattagccgcagaatcgatccccagactggagaatatctggacaaatgggctaccattttggccaatttgattccacggatagatacacatcaggacaaacagagtgagtacataaaacagcaaaatacggaatggaacagcgttgattgcctggggaatggatttttctggatttttcgcttcactggctgtaataccgataacctcgataccaccgaatgcaaacatgaccaccgtaaacgaagcaatcactcccgcgatgccatttggcatgaatccgccatgttcccacaagtttgacaggccagtgacatgacccgcttcctggccgaaaccatacatcatgatcacaaagccaccgacaatcatggcaacaattgcggtgactttaatgatggaaagccagaactccatttctccaaagactttgacgttgcacagatttatcgccccaatgaaaaagacgatgctgagtacccaaatccattggtcaacatgcggaaaccagagtttcatatagagaccaaacgcggtgatatcagcaagacagacaaccagcatttcaaatacgtaagtccatccggtcagaaatcctgccaatggccctaagtagtggctggcataatgagagaaagaaccggccacagggtgatgaactgccatttcccccaatgcccgcatgaccatgaaaacggccgccccaccaatggcatatgccaataataccgcaggccccgctgctttgatggcttccgctgaaccatagaaaagcccagtcccgattgccgaccccagcgccataaaccgaatgtggcgaacgctcaagccccgcttgagttgtgaagtgttttgcatgatttatccttgtgtctttattattagatatgaaagataaatacaacgataaggccggatagaaaccggccttagacgacttatttatgtttaatttctcaatatctttccggtaggcagcagtgctgaaagttgttgtgcaatcaacagttggatagccgcgtcaatgtctggcgcaaaaaagcgatctttatcgtaataagcgactttatcacggaggatatgacgggctttttccagtatcgggctgctcttcaatccgtcacggaaatccatgccctgacaggcagtcagccactcaatcgctaaaataccccgcacgttgtcagccatttcccataaacgacgacctgccgccggagccatagatacatggtcttcctgattcgctgatgtcggcaagctgtcaacgctggaaggatgcgccaatgctttattttcactcgccaacgctgccgctgtcacctgagcaatcataaagccagaattcaccccgctgttattgacgaggaacggcggtaactgggacatgttgctatccatcagcaaagagatgcggcgttctgacagtgcacccatttccgccagtgcaatagccagattatccgatgccatagcaacaggttcagcatggaagttaccgccagagatcacttcatcttggtcggtaaagaccaacggattatcagagaccgcattggcttcagttataatcacgtcggcagcatgacggatctgagtcagacaagcgcccatcacttgtggctggcaacgcaatgaataagggtcttgaactttcggacagtttttatgggattcagagagaccactttgttcttccaataccagacgatacaaggcagctacgtcgatttgcccctgctgacctcgcgcttcatggatgcgcgcatcaaatggtttacgagaacccagtgccgcttcaacggacatcgcgccacaaacaacagccgaggcaagtaagtcttctgctgcaaagagtcctttcaaggcaaaggcggtagaggtttgtgtgccattaagcaacgccagaccttcttttgccgccaaccgaatcggcttaagatttgccttttccaaggcttctttggctggcagccattcaccacggtaacgcgctttactctcgcccagcaataacaggctcatatgcgccagtggagccaaatctcccgaagcgcccacagaacctttgctcggaatacagggataaacttctgcattaaccagagtaatcaacgtttgaatgacgtctaaacgaataccggaataaccacgggcaagactattgatttttaataccatcatcagccggacaatctcatccggcaaaggctcaccgacaccagcagcatgtgacaacacgagggaacgttgcagttcttctaaatcccgctcggcaatccgagtactcgccagcaggccaaaacccgtgttgataccataggcggttctgttttcattgataatacggttaacacaatcaacgctgcgttcaatggcaggaaaacactgctcatccaaggtaatttgaaccggatgctgataaatgtggcgtaactcttcgaacgtcatttttccgggatgaatagtaatgtgtttcatattaatgacgttccttattttgtttcgacggtttttgtgtctgatgattttgtatcaagcatcggcaggttcaggttcttctctttggcacactgaatggcctgttcataacctgcatcagcatgacgcatgacgccagttgcaggatcattgtgcagcacacgggcaatacgttctgcggcttcatccgtgccatcacagacaatcaccataccggaatgctgtgagaaccccataccaacgccgcccccatgatgcagggaaacccatgtcgcaccactggccgtatttaatagggcattcagcaatggccaatctgaaactgcatcagaaccgtccttcatggattcggtttcacggttgggactcgccacggagccggaatccaaatggtcacgtccaatcacgagcggtgctgaaagttcgccgctgcgtaccatctcattgaatgccaatcccaatttggcacgatctcccaagccaacccaacaaatacgagcaggtaaaccctggaagctgatgcgttcccgcgccatattcagccagcgatgcaggtttgcgtcatccggcagcaattctttgactttggcatcagttttgtaaatgtcttcaggatcaccggaaagcgcagcccaacggaaaggcccgattccccgacaaaacagaggacgaatataagcaggaacaaaacccgggaaatcaaaggcgtgttcaacacccatttctttcgccatctggcggatattgttgccataatcgaaagtaggaacaccctgtttctggaaggccagcatcgcttccacgtgtactgccatcgatgctttcgcggcctgaatcacgacttctggctcagtctcggcacggcgacaatattcttcccatgtccagcctgccggcaagtagccatgcagtggatcatgtgcgctagtttgatccgtcaccatatcaggacgaacgccacgacgtaccaactcagggacaatttctgccgcattgccacacaatgccaccgatactgccttaccttcttgggtatatcgcttaatgcgcgccaacgcatcatccagatcggctgcctgttcatcgacgtattgggtacgcagacgaaaatcaatgcgactttgctggcactcaatagtcagtgacgaaacgcctgccaacgttgctgccagcggctgtgctcctcccatccctcccaaacccgcagtcagtacccagcgcccggtcaaattaccgttaaaatgctggcgtcccgcttcaacgaacgtttcgtaagtgccttgcacaatgccttgactgccaatgtaaatccaactacctgccgtcatctggccgtacattgccagccctttagcatccagttcattaaaatgttcccacgttgcccaatgtggaaccagattcgagtttgcaatcaatacacgcggggcgttttcatgggttttaaaaacccctactggcttgcctgactgcaccagtaatgtttcgtcattttccagatttttcagggtttccacgattttttcataacattcccaatttctggcggcacggcctatccctccataaacgaccagttcatgaggattttcagccacatcaggatcgagattattcatgagcatgcggagcggggcttccgttaaccaactttttgctgtgagttgcgttcctctgggggcacggatgacctcgttgctgaatttattattttgcatcgtcacggttttttccttttcatctttataaagtttgttaattgtatagttgtatatacatgtagattcaataggaaaaaatgtgacacagataaagtcaataatttggagggtggtgtcttttatactaaatatcaataagatgataatgatttattcttcagttggcaggtgaatgtttttattggttttgtgttttacatcacatgggatttacattatggtcacaattgtttgtgaaaaaatctccctatactaaaaacaaagggagatttttttatgtaacgatgggcaaatcatgagctgaaatgccctttcaatttatatcgatgtccaggaaataataatttagcacttgagacaatatgttctttcgaccatgttcggcggctgatgagaagacaaggcgtatctgcctcaatttgcagcaaccgacaagaacggacatctcccgcaaccgcttcaacaatatgctccccttccgtcaggggagccaccattgataagtaatcgtgggtagtttgctgattgaaatcctgttgcagatacgccggcacagcctgagcgttgacataacgattttcaatctgcacggggacatcattttcatagtgcacaataatcgaatggtagattgccgtacccgccacaatccccagttctgccgcctgtgttatattggcattcacttcagcaagtttcagtactttacaactatgctggttagaacgtgccgcaatctcaccggcaatactgtgaatttcaaacagagcggactgccctttgggttctgaaacaaatgatcccactccttgcaaacgaaatagaaaaccttctgccatcaactcccgcaacgccctgtttgccgtcatgcggctacagctaaactgtttgaccaattcagattctgaaggaacccgatcatggggtttccattctcctgtatatattttttcaataatcgcctgcttaacttttgcatacaaaggcacaggtttgacaaatgtatctgataaatcaactgtcacaataaatcccttctcactggctacccattccaccaatgcaccaattgccacgcaaggcgagccgccgctttgcctcccattccttgaatgtcatacaaaggattaagctcaaccaaatcgacagcctgtaattttttgctttggcagatgagttgaattaacggcaacaaacgctctaacggcactcccagagcagcaggagcagaaaccgacggcatttgccagattggcagtacatccaaatcgatggtcatataaattatatcaacttgattaatcacatcttgaatttgttcctgtactttgtccagcatcgactcaatacattgagtatcccaaataatagtgacatcaagatgattggcttcgtccaacaaagcctgagtatttgatgccaaactggctccaatacaagtgtaattgaacggacgctgatgctgctggcaataatcggcaagctgccggaaaggggttcctgatgtaggctgcggcgaattgcgcagatccagatgcgcatcaaaattaatgatacctacgcgttgtgtcggaaacgcgcgataaattcccattccatgagcaaatgccgtttcatgcccaccgccaaaaatgagtgttcgcatgttctgatgctggcactcatagacagcatcactcagcgcgttctgtgcttcagccaatttctcagtatcagcgcgaatatttcccaaatccaccagctgctcatgaccatcataactggccatatttgccaatgactgacgcagatattccggccctaatttcgctcccggccgaccatgattgagtttaacgccttcgtcacactcaaatcccaataacgcaatatggtgaggaaattcttccggggaaaaattggcaggttgttttattgtctggaacacacgcagggcattatccgcttctgcgagatcattacgcccttgccaaatgttttctgatgtcgggtgccataatttcatgttgtttctctcaccattattgaaaattatgtgtaatttcaccacgatagatacgatgaaccaatggattacgtccaagttcatataagatatccaccggattttcggcatcccagacaataaaatcggccatataaccttccgctaattggccgtggctttcagctctccccaatgcacgggcggcatgaagagttacaccctgccatgcttcttctggcgtaaacccaaattgcacacaggccatattcataatcagacgcaaagaagcaaaaggactggtacccggattgaaatccgttgatattgccatcggcactcggtattgacgcaacagcgaaataggagggagttttttctctttcaggaagtaaaatgcgccgggcagtaacacggccacactaccgctgcggctaatggcttcaatacctttttcatccagatattcaatgtgatcaaccgaccagccttgataatcagcaaccaattcactgcctcccatgttggacaattgctcaacatggccttttacaggaatattcaggcgttgtgccgcatcaaaaacgcacttagtttggtcaagactgaaaccgacggtttcacaaaaaacatccacggattcaaataattgtttttgccacagtgtaggaagaatggaatcacaaattaaatcgatataagcatcagggttgtgtttatattcaggtggaacggcatgagcagagagtaatgtggggctgatttcgatggcatttttctgcgccagtgcctgaacgacattcaactgtttttcttcatttaccagatccagcccatagcctgatttcatctcaatcgtcgttatcccttcagcgatcagagcattgagtcgcttctgggcagccacttccaattgttgcgcagaattgtttcgggtcgcattaaccgtagaattaattcctcctcctttggcactgatctcctcataagaagcgccattgagacgctgctcccactccgatgcccgattgccaccaaaaatcaaatgagtatgacaatcaattaatccgggggtgatcaaccgctgttccacatcaataatgtggcaatggtgagttggcacgctatccgtcggaacaatcgccaatattttttcaccccgaacgatcagatcatgctgctccagcatgccataatgatgtttgccatcaatgttgttgattgtagggttcattgtggcaagtctggcattacgccaaataacgtcagtatctttcagctcaatagacattgtatcgtcctgttatttttcttgttggtatcaaccttcatgttgtatatacatttattttataaccagccaagattgtcaaatcattttatggacacggatgaatatcatgaattttctagagactatccgtcacgatgcgaatatattgcaatttacacaatcacctaaatatacatatcaattctatgcgatagcttctaagcaaaatcacaaaaaatcgggtacaattaccaaaatttgtcagtgaattagagagtaatgaagaagaaaaatctgatgagtgaagaagatatcagtctatttcgaacgtctgtcacgggagcccgccgcatcgttcaagacaccgttttacactcccctcaaagaaaaaaaatcagctatgttgcacctgcacgtatgatgcaagaacaagtcgatgccagttactatttttccgatgagttccaacccaatttggatatggaaggcccaacccgctatattcgagaaggtgcaaatcattatgaattgaagaagctgcgtcgtggtgattattcccctgagctttttctggacttacatggattaacccaactacaggccaaacaagaaattggcgctctgattgcagcctgccgtcgtgaacacatttattgcgcctgcgtcatgcatggccacggtaaacatattcttaaacagcaagctcctttatggcttgcccaacaccctgatattattgccttccatcaagcccccaaagagtggggaggtaacgctgcattgctcattttgatagaaatgaatgaacttatgcagcgttaatttatcctctgtatgaagttagtctttcgctgctaactgcgccggagaggtttgccataacaggcggcctttctctgtttgaggatctaattccacacaggcaatactggaggtagcaaacataggcggagtttgctcagggcaaagctcagaaactaaataacctactaagggtaaatgagaaaccaccaatacagcgttgtactcttgcgttgccaaaacctgcaagtagctcgccaccaatgcgacatctcccgacggctttaactcagccagttcttcctcattgccaggcaacgctaagttttcacgaaccacctttaaagtctgctttgcccggatataagggctgactaagatacaatcaacatcaggctcttgttgcgtaagccagcaggccatttcctgtgattcttgctgcccacgaggagtcagctcccgtgttgcatcactgatcgaatgtaaggcagcatcaccgtggcgcataataaaaacgtacataatccaccgtttagttaatttcagaacctgtccccatccaatacataattaaatatttatgagacaagccatggggttacggcattaataatgaaatccaagtgatattatcaaggtaatctttgttacaaaaacgtttcagttagagctaactggcattttgccctaaaacaaaaacaaataaaatgactaaaaatgatttatatctgattgtctcgatatcattatctcctgctattcagtgagttaaaataatcaagaaaccataaattatttttcataaaaaaatcggctccgataacaagagccgatataactgattttacgaatgaaactgttatttatttgtagaatttctttttctgttcagccatctgaactaaatattcacaaggcgtaaatctctctccgtgctgctgttccagacgacgtaaaattgccacaaccttatcgctgccaagcctatcaatataacggaatggacctcccaagaatggcgggaaaccaatgccaaataccgcaccaatatcaccatcacgggggcttctgataataccttcatctaaacagcgaacagcttcattcaacatgagcatcatgcaacgctgagcaatgtctgatggttgcatttttgcatgtggcttaattttcaacagggaataaatcgaggcatccacctctttggttttgttgccaaaaggccagaatttgctctttttagcgccatacgaatagaaaccacagccattctttttaccttttcggttatcttttaatactgcatccaagaagcctggtgcggtaaatctgctccccaattgtgccaccagaataggaataatttttgtaccaacatcaatgccgacttcatccagcaaattaattggcccaatcgggaaaccaaaatctaccagtgccttatcgatatgatcgatcggttcaccttccgccagacaataacccgcttcattaatgtaaggggacaaaatccggttaacatagaacccggctttatcacccacgacaatagccgtttttccctgttttttggctagtgcgactgcggttgcaatcgttttttcacttgttcccgcatgtggaataacttccaccaatggcattttatcaacgggactgaaatagtggaggccaatcacttgctctggtcgagaggctatttcagcgatctggcaaattggcaacgatgaagtattcgaagcaaaaattgtttcaggtttcgaatgttcttcaacttctgcaaccatttttcgtttcagcgccaaatcttcaaatacagcttcaaccacaatatcagcctgtctgaagccactgtaatcagtggttcccgaaatcaaggccatctggcgagaacgctcgcttgatttcaaacgacgttgttttacccgcctggaaagaatatcccagatatatttcagagcctgattgatacctttctgattaatgtctttgatacgaacaggcaagttaccgcgtgtcatggtaacgttggcaataccgccgcccatcaagccgccgcccaaaacccccacatacttgatctcggcaggctgttccgacgagccggtttcattttttagcgacgttgaggcaaaaaataagctgcgcaaggcttccgattccggtgacattgccagttcaccaaacgccttggcttctgcctgaaagccttttttaagccccttttccaatccggtgcgaacgacattaataatacgctctggtgcaggatagtggccatgggttttcgcacgcgttttttgatgaaccatatggaacaacaatggcctgcccagagtgctcgccaaaatacgctgagaccatgccaatggcttacgcttggagatgcctttcttgacatactgaacagcaacatccagcaaaatatccaaaggaacggcatcatccaccacacccagacgctgtgcctgcttagccttgagctgtcggccagtcaatatgatatccagggctgcactgacgcctatcaggcgaggcaatcgctgagttcctccagagcccggcagtaatccaagctgaacttccggcaaaccaagacgagttttatcatccagagaacagacacgcgcatgacaggccaaagccagttccagccctccccccaaacacgcaccgtgaatggcggcaactacaggtaaacgataattggcaatttgagcaaatagcctctgacctttttcagccagttccatcgcatcttcttcggtttggcagcctgctatcatcgtgatgtcagcaccagcgataaaagtatccggcttaccagacacgatcaccaaccctttcaagccagaggcctgttgtgccttctcaaagacagtcagaaattgctcaacaaattccgctttcagtgtgtttactttttcgcctggtacatcaatggtaatcacgccaaccttgtcatctctgaccgaaaagctgaataccgattgcttcggttgtgtctctgacatcatggtttctttttcgccctgagccattattctacctccaataccatcgctacgcccaatccacctgcggcacaggctgtcgccagcccaaacccgccaccacgacgacgcaattcgttcaatgtctgggtgaccattctggcacctgtcgcggcaaatggatgaccataagctattgaaccacctaatacgttgaatttatccatatctacgtcacccattgcctgagagcgccccagtttttcacgcgcaaacttttcactggcaaacattttcaagttcgccagtgtttgagcggcaaacgcttcgtgcatatcaatgagtgagagttcattcaaggtgatacccgcccgctccaacgcaatcggcgtcgcataagatggccccaacagcatatcttgccagacatcaatcgcagaaaacgcataactacgcaaataacccagcggggtcataccaagctctttggcgaccgattcgcgcattaacatgactgcggcggcaccatcagtcaacggagtactattcgccgcggttacggttccgtacttacgatcaaaggctggccgcaatttggagtaagatgtgagaactgaattttttcggatgttattatcttctgtcaatgtgtcgcggtatggcggaaaatgtgccgctaccacttcctcattcaaacaaccctgctgccaagctttggctgccagtatatgggaacggtgtgccaactcatcctgctcttcgcggctgatatgataggttttagccatttgttccgccgtatcgcccatcctcaatccggtggaatattcagcaaccgcaggagatactggcagtaaatcccgcaatttcaatcgactgattaattttaagcgctgtgacaaactcttggctttgttcatatcgaccaaagtgcgagccagtgattttgttaccccaatcggtaatacagatgaggaatcagcgccgccggcaatgcctacattcactgtgccagccataatactttcagccacattcgcaatcgcctgaaagcttgttgcacaggcacgagaaacactataagcatcagtgctgacgcttaatcctgcgcctaatacgatttcccttgcaatattcggtgcttccggcatttgaacgacttgcccaaacaccagttggtcgatcttctctggcgacaatccgcttctgatgaccagttcactgacaacggcttttcccaaatcgacagctgggataccatggtaactcgttgcctgtttcgcaaaaggaaggcgcaacccactgacaatagcaacacgctccttttgctgtgccacttttgttgaagaacgacccatagcaactcctgacaataatcattaattaaatcaattgattgattaaaaatatttactcacctcacaagaggtcagacctgatggagcattgttaacgcaatgttggaaaatagcaaacaggaatagacgaaaaatgcgagcaagagcaacaaaccgcggtgggaaaacggttaccgaagataattaacgtaatcctaattgaaaaatcagggcctcagcctgacagctaaacgtaaaatctatagtcagttgcgccccatcgtcaactgcttcgattttatggcttattacgcatggctctgactccactgattttgcctttacagtcaatgtattaagcatcatttccgcttcctgtccattggcaaaaacacgctggtaagaggcggtgcagtcttcattgtcaatgacggtaccgacatcaacgcaacagcaggtggctgtttcttccacattacaacgtttaattgtatcaggcatttttttctcctacgatgaaagcctatcgatgattttacgttgttccaacctccgataaccagcgtttacgctgtttggcatcacttatttcattatttattgatctcatcgcgctaacaaactagccatcacaattcgttaacatgcgctgcctgttttttgttaagctcgtcccatttcggtaatcattttagacatatcttaaaaacattcttgcaacatcttctaatgtcaggcctatacttcctgcactggtctgatttgtcattatgataaaccgactctacaatcccgcgctctcagctacttgagtagcatgttaaataataattaaataatgaggttttggttatgagccaaaaaaacctgtttacgcgttcagcattagcagtggcggttgcagtcatttcatccaacgctagtgctgccggttttcaattaaatgagtattccacatcaggacttggtcgggctttttctggagcaggtgtcgttgcagataacgcgtctgagggtagtcgtaaccccgcagccatgaccctatttgatcgcccatcattttccagcggcttggtttatgtaaagccgaacgttgatatcacgggtagatctccagttcctcaactaggcactggcgttaaaaacagcactgatgctaaaaatattgccccacatgcatggataccaaacttacattttattacaccgatcaatgatcagtggttcctgggtgcatcagcgacgtccaactttggattggcaactgaattcagtaataactatgctgctggcttggttggaggcaaaacctcacttaaaaccgttaacctgaacctgagcggtgcatataaatttaatgatcaatttagctttggtttgggtgtcaatgccgtctatgcggatgctactattgttcgtcacatgggtgaagttggtccttataacccacgagcacctattccagcaacctatgaagcttcccgtttagaaggcaaagattggggctatggctggaatgcaggcattctgtatcagtatgatgagaataaccgttatagcctgacttaccgttcaaaagtcaaagtgaagtttaaagatggcgatttcagtaacgacttaccagagtttttacccaatggcactggcggcaatacaattaagggtacgctggatctgaatttacctgatatgtgggaagtctccggctataaccgtgtcgcacctcaatgggctattcactacagcttcctctatactggctggagtgaattcaaggagctgagaggcaagaataaaggcaacggtaacacgctgttccacaaagatgaaaacttccgtaatgcctaccgcgtctccctgggtacaacttactactatgatgacaactggacattccgtactggtatcgccttcgatcaaagccctgtgcccgcccaaaaccgttctatctctattccagatcaggatcgtttctggttaagtttgggaagcacttacacattcaataaagatgcctctgtggatgtcggtgtttcctacatgcgtggaaagaaagtacgtgttagcgaaaaattaccagaagatgttcaaagaggaccttttagtcaaccctatgagttcgattccaaaggaactgcatggttgtacggtgtgaactttaactacacgttctaaccgaatgctgtgatcgaaaaaaggatagcgggtgctatccttttttgatcatggcttcatcattaatcaatggaatccaattcgtcctgaatcaccgttgcattagggttttgttctggcgagagcttgcctccattgaccataaaatcatgacgctggaagtacgcttcacgcatcatcaaatatggatcggaagagtttttcaataggccatcggaatccagcaaacgtgcgcgggtttcaataccttcaaatacccattttcctacggacatccaaggtgtgagatagctcaatacggggtaagtcatatccgcgacattccctccttcgtcacgcagagtgaaattgccataaccaggcaaaacaacataagggccataaccaacattgtaataccccagcgtactaccaaaacgcattggatcttcctttgccagcttcggattcgccattgaagcgacatcaatcaacccgcccattcccagaagggtattcaaaaaaaatcggttgaaatgcttcgcgccatcatggatatcaccgcgcagaatactgttgaccatactggctggctcttcaaggttactcacgaagttaccaatgccatttcgtgctggcatcggtacataatcacgccaagctacagcaacgggtctcagaagataaggatcgagaacatcataattaaagttgaacatggcacggttgaagccctccagcgggtcagaacgcccttgttccaccgaattcgatgaactagcacaccccaccaataatactgctgtaagagccaccccgctcagacgatacttcatgttgttctccacgtaatcacttttagacattggctctcaccttgcattctgccaatatttaccaatgcgttaaatatactttcaatttctcattattggtaatcaaaaagagtggtgattaaataggcaaacagaacgtcatgtcttatctcaagcaaaaaaacagttatactacgccccgttgtccccttagttaaatggatataacgaataaagaagacattttattgttttataaagaaaaaataagatcattaaaactttaaaagtacactaatatgtacacaattcagaaaataccttgttttacctccctatcattttactacttatagctcacttgcaacagctcgcaatcaatatataactcccacacagcagcccactgactacattgatgagatatcgaccgctacgactacctgaaagagaagcgggggattgtggagaggtgggaaggaaggctgttgtcactttgatcgaacttcggttgacaaaacagtgtcaaccaaatttaccaaatacagtcatttcgtcaaccagcttcctccgctggaggattcagaaaaaatcaaaaggttaaagacgggaaatcccgcctttatctatctcatagttttatcagtgggatatggattttattaatttccaaacagtcatttcgtgtcatcctgacatcgcaaacataccattcaccaaccgagcttagtcaaaacgcattctccagtattgatgaacctattttattgatgttcactggcggagcagtaacccgccttcatgttatttagcaatgagtattgttgattaaatgagggagtaaatatgagtattcaaaataataatcctgatacaccatgcccttgtgactgtgatcttttcgtggtacccagtcgtaattatgtaaaagaatctattgaagaacatgcccaaagccgcaatcaccccaatgcaacattgcaagataaaggatttgtgatcctgagtaatgatgctgacagtaataacgaaactagtgcagcaacaccaaaagcggtgaaaacagcgcatgacttagacgctgtcgtcatgatattttcagccaaagaacaaggcaacggatttgcactgcggcaagaaaagacgcgctattttttgcatagcgagtggctataccacgccagcgcttaagatgaaggaaagcattttcaaccaaatggcgaaaccgatagagttcacgatcatattctctggcggccttccgatttttccggctagggatatggacttgcatgccttgttgttctgctttttctactattgcgttgctatcatagcccctgtccgccaatagatgctctgcatcgagccctttaattaaggtctccgcttgtgaacaatctgctgtggtaccgcttgtaataacaattctgaccggcataccatgcgcatccacggccaaatgtatcttggtattgagcccccttttgtgagccccatatcctgattaccccctttagcgcctgccgcatcgggatgaaccttaatatggctggcatcaatcatcaaccactcgaaatcggggtcattaaccaattgttcgagcagtttttcccatatccctttatctctccagcgacaaaaacggcggtgggtatttttccagtcaccataatcagtatgtaggtctcgccaaggcgcacccgtccgtaaaatccaaaacaccccattgataaaacgccgattatcttcagctacacgcccccaagcgccttgacgtcctggcaaatgaggttcaagcaggctccagacgcgatctgaaatatcgtggcggcggtgtgcaggtgtactcatggttaatcaactcttatgatggaatggtggggcattattattgcacgaaatttctcatgacgacaccatctagcaaacttagcaaatcaaaatgccaacaatgcaaatataaatgctaataatcgcttagatggtgtcgtcataagacatttaaccaaagagcaagacagcggatctgaacagtagcaagaaatgaggcactatttttggcataacgggtcgctataccccgccagcgtttaagatgaagaaaagcattttcaactaaatgcctgagtcgatagagttcccgatcatattctcgtttcactttgcgattttttcggccgggaatttgcgctgccatgccttgtttttctgcttgttcaacaacggtattactgtcatagccccgatccgctaataaatgttctgcatctattccgtcaatcaaggcctcagcttgtgagcaatccgctgtgggaccgcttgtaataagcgctctgatcggcataccatgcgcatccacggccagatgtatctttgtattgagcccccttttgtgcgccccatatcctgattgcctcctgccgcccctgcggcgtggggatgaaccttaatatgactggcgtcaatcatcagccattcgaaatcgggttcaaagatgagttcttcaagcagttcttcccatacgcctttgtcccgccaccgacaaaaacggcgatgcgtatttttccagtcgccataatcgggcggtaaatctcgccagggtgcgcctgtccgtaaaatccagaacacggcattaataaataatcgattatcataagcaacacgcccccaggctcccttacgtcccggcaggtgaggttcaagcaaactccaaatatgatcggaaatatcgtgacggcggtgtacgggtgtgctcatggttaagtcatccattcatgtaatatagggttattattacatgaatttatttatgacgacaccatctagctaaagatcagaacggcgcggacattcctgacaagaaagcattcattaaaaacctcggtttagtgagcaattcaactttacctgtcggagtccccgttccttggccagcagaaaccccaccagaaggctggttgatatgtaacggtgactcatttgataaagcaacatatccgaaactggctcttgcctatccctctggaaacctacctgatttgagaggggaatttattcgcggttgggataatgggcgaggagcggacgttggtcgatctctactttctaatcaagtggcagatattgctccacatagtcacaggattggccgcatgtggtccagctcaaacggtggagtcgagggtttgggtacagggaaccgcattttcaatagtgtccaccaagacattaactacggaattgatcctcgcggactaggcattgctataggaatgggatctggtggtgtcggttatatggataatgcagttgctgcttcaacgggaacagaaacacgtccccgcaacatagcatttaactacatagtgaaagcagattaattgattccacaggcaaggaagaccgcgctatacctagaaaatattctaatcccagcgatggaatggtcggacgaataatccttaacccgtaactttccgcgggttaagactggcttcattcttctaccatccccagcctcacaccgaccccaacatccgccccccaatccacccaactacccgctaatctcccctaatggctatttattgacggctgacgtgatgtcatgctcctgctgaggatcagacgccaatgcctgtttctgattccagatagaatcctccggcatctggacacgggcgtctaaccgggtgccggcgggtaaatcacagggttcatcaaccgtgtaatgcgtctgctcatcctgtgacttgatgcgtcggttctgcaatcgggcaggcatatgcgcgttctgtcggtgcgtcaccttgatttcaatagccccatccggcagcactttatcctcgacatacactaactcattaccattgacgtcacggggaacactgataccgccatgaacaccccatgcaccgtcagcgttatagccaaggatgccggatattctgtagtgaccaaggccgagtttggtcacagtggcaccttcggattcgtcgttagtggtaaaggtgccatcggggtggagttggataatagacgaggttttcttgagaaaaccgttgccgtcaaagacggcgttgcgattatcccacgcgactcgccagttcatccaattaccgttatccccattcttggcgcgatatcgtaattgtccgtcccagtacgctgtcatgatctggaatggatacgaatttacatgatccatagcaaactgaaccattgttccagccacgcctgagctgccgtcaaccccgtctgaataaacaaaatatatttggttatttggcagattgtttaagcttttccctctttttcccactccagggtctgggtgcacaacattcgaatcttttcctgtgacaacatcataaagatggtcttgatatccattgccacccgcaaacctgacaccactaccactataatcaatagaaatattgccccatgtatcgtaggctcttattttcaggttggaaccaaatcgataggtgtatgcgcatgcgctgtcatttcggtatatctcactgacatactcatccctgagccaactaaggagctgagtagaatctttttgtataattcggcctccaccaccaaagccataatccccaattttcattactcccgataaacccaggtttttcacaaactctgatttattctggatatccgccgcgttctggaatttatccagttttccctccaccgcagcctgcaatgcccggatggagtccagcgtgactttctggccgttcggcatctccacgtcaaccttgccgttttcactcatccatcggtccatgttttgcaggaacaggatgatagcggcgttaatggcacacatatgccggacgccatcggaaacggtatcgggaacggtggttgagatgacatattttgcattgttaagactgactgagggcgcaaaggccagcaccagttccgtgtctgaattcaccgactggatgacattctgaatcaccgtattaccggattgaatggagataatctggccggcggtaatgccgttaatattacttttccatttagtgcccgttccccggacaatagtgacctgtccgttcttcacctcagatcccatcaccatcccggctttatggaactggtctttgtactttaatccgacacccacgtcatagagagcagccccatctcctttaatatcaaagaccgccgtggccttcgtctgcaccgctgccgcattctcccccacatcggcctgtactttcttcatatcctcggcaaaggcttctcggtccgtaacctgcgtggtctgaacgtgcaatatatctgctttaagatcaccattcactttcaactgtcgctgaacaattgccccttccaccgcggcgttctccatgatggcttcggagttaaagtccatctgctcctgcaaccgctggcctgctttgttggaaagaaattccttacctgccgcatcgatgatccagttcgtatccgaagaagactccccacgaatgaatgccgtccacggggactgattaccggacttgtccaccagccgcgcacggaaatagaaggcaacgcctgccgccagtccctgcattgtgtgcgttcgctggggataggggatatcggccagtaacattaacccttcactgtcattcgtcttgctgtactggatttcagtttttaacgtgtcgtccgtctggggcgcaaacccccaatctagctggataccgaagatgatcggggtggccttgaagcccaacggtgccggagggttgccctctttccctttcagatgagtttcaggggcgtttgcccagagactgggtatctcagcggcattaatggctctcacccgcgcctgatagcggccagcgtagatattgggaatttcaaagccctgtgtagaggttcggggtgcagatatccagttgccgttatcacgccgccattcagcttcatacgcaatcgcactctcggctgcattccaggtgactctcaatgtcgtgacggcaatcccctgattcaccacggaataactgctgataccgacatttttcggtggcagttgaacgccgggcggaatgacagaaatggggcgctcgtctattcgggtgccagtgtcgatatggtcatacttatcggggttatgctcaacggcggtgatatcgaatgacaccccgtcctcaccctctttaatccccgtgaccctgaattgctggacagccaaatccgtggcatcaatcgcccagacattttcagtggcggggatttctgagtattccgtggtgacagtaactatctgcccattgacggcttggatagttcgcccttccgctttaccagaaggcaggttcagaattaaccgctcaccgaccttcgcagacgataccctgtctaatgtaatgttacgcccatccaccgcactgatacgtccacccagtacacgaccggaaaacatttcatccgccacaccgataatgtaaccgggtaaggggatctttccatccaatcccaccgtaaacgacaccatgcggttacctgcataataatgacatcacccatctgtaattcactgctgcattcagtaaacccagcatcagcataattcttcatatacaagttttcgccacgctcccaccagccatctgagcgctcaaaatcaggaatatcaatatcacgctccagccgataccagtcacgcacgatggcgtaacaatcccagataccatgtacaaatggacgacccaacaacggcttaatcccctcagtcggcataatggtacgaatgtcactctccggccatgagacaatcacccacgggatttgtgacaggtcacattgcgcgatatccagttgactgggttgtgtcgtggcatcggggtgactgtgaacaatggcaacaatcgtgcctacgtcttcggcttcggcgtaatcgactgggtgcatactgaattgttctgtcggtaaaggtgcggtattgcggcaacggatatattgctgcttgcggctattttggatgaccagaccgcagcattcattaggatattcggctttagcgtgatctataatggtatcgataatatgtttacgcagcgtttccatatcaccgccttaataacgctgaaccggggaagccaccaaagggaagttgatttcctttcccgaagcacagctcacatcctgttgacaataatccagaacatgcatcttttgatggatcatctgttgggttcccgtcctcatcaaaataccgatcaccggtatagttacatggggatttgcgatataacccccgcatacaccacgtacaaagactgtgtatctgacgggtaggaatttgaatcccttgtaggtcggcaggagaagacaaagcaaaatgaatctctgtattgtcctcatgcgtcttactgtcaatatagtagacgtctattttctcttgcgtaggatcagcttctgggttgccctcgggaaaattacgggcatccagataatgcgcaaaggtcatacgaagggtgacacgcgcctgagccatattctgatatgccagacacatggcgctgatagtgccgtctagattggcaacactgagcgtgggtgacactgttctaccatcactatttacctccaatccctcaattctcacaggccacggtttatactccacaccctgccaccagattgatttaatcggcaggtcgtccggattttccagttccgcttctgtgtaaggaatggtgtgattatgaaagtacaattctggcccaccaaaggccgagccatcgaccgaaaacaataaaatcttatgccccacttcaaggcgctggagatctgcattaatagtcatgcgctgaatgcctgttcaaaagttgctgatactttcatgatgcctcccgccataggggtcatggtgattgagtcagatttgactcgatacaatcccttttcaccaaacggaggtctccagataaatgattttgccgtgtgattacgaataaactgaaagattggaaccacttcttcttttgctcctaaataagaataaggccatgattgcgtttcggaattaattccatcagcgacgacctgtttgtaaccatcaccaaactcaattgatttaactcggtgtttaaattcttcgatagccatataagtacctataaaaagaaaaaccgcagttaagcggcttggattttgatgtaaaaaaccgcactaggcggcatatatggaaaaggctacgcaatgcgcagccttgaattcataggggttatttaatatgttatttattgcagagtatatattctaacaatagagattcttgctacagagctattaaatcccgtggcttgagtgagcgcctcgttctcgaccgcaattaaaaaatcactaaccccacccgtactccaatcaaaatctaaagcaatctgcgagttaaccagagctgagttgtcactaccaagggcgctataggtaacaatatattgattcatggattgatcctcctctttattttgtctagcacacactacagcgggtattttctttttactatttgattaattaatcgcctgtcataaatttcattcaagccatccgtagtttggagttaatcagtatatttagctctatcccgaatctctttgatacccattccgaacacagcacgatggtttgcgcatatccagcaagagcataggcaaggtgtccgataacatattcctgctgatgttttatcaggttgaccaccagcattatgatacttactacgttttgcctttaagcggtacatgtgatgtcgtctgacagcacgatttcttactttcataaatgaacccacgtaattgttgcgcgaccgcatggttatgcagccgcttaatcgtgagttctgaacggattgtttttctcatagtgaatattaacggttgtgattactaattatatcccatagccagtaacggtctcttccaaaaggtcattccggtaattagacaaaatctttagtgcgaaagcggtattgtcgcaatcggcctcaccaatagctgccaatattgtcaattttaccagctcaaatgacgcattgagttcaaatccattgagtattaagaagatactcgttgcctgaaaagctgttcgtttgtttgcatcattgaaagcgtgtgatttagctatcgctatcaagtacatagctgcaaatttgaaaacatcttcgcatccttcataatctctcaatgtctggacacgaaataaagcaccctcaagtttattaacatcaggctcgccgctattcggaagtgtttttctctgaatttcaataacttcttctgttgagagaaattgaatatccattatttatcttccaatgcctttataatatctgcatatttagtttgagtatgcagcaaggctttcctgaacgcttcggaacgagcatcatcaatagagttagttgcatcagtaggctcacgctttgaattatcagcctgtctcgttatcttttggatgtcgttaactttttccatatgcacctctttttctgtatgtgtacagattagcagcaccaataagacagtcaatgtatataatgcaaggctggttacaagccatccgtggcttggggttatgcgttgaacttgtagctttctaacgccttcatcatgggctgcatatcttctttatgtatcagcagatagccagcacgttgggctatttccataaagtcatttatggtcgctacatggtgatttggtgtcagtgctgaggaataaaacaacctcgccgttttccagttccattagtaattttccgctgaatccagaataaccatgcaggactggcaattcttctttgccaagatattcaccctccattgccatcttgtgaacatattcgatagcctgtggtaactgatcggctgtcagttcatctatatgctctacattgaagcgttggtgaactaacgaataagcctctgggtacatgatacctttcttgctgaccagaaggttaacggcgttctttagtgggttccgttgttggactgtggttttggtcttcgccttaacctcacccgtagtccagtattcataaagaacatcgtcgcactcatcttgataccggataactttatccctgatcgatgctttaactttattggggctgatagttgctaaccagccagcaagtttgcggagggcaatgcaaatcatctccctctttttaccatctgcggcaactataacgatttccgttacagttgatttaaacctttgttttatcttctctaactgcgattgccaagctagccccatgccatcgacaatcggcttcatcggtacatacggctcgccgttataattaacgacatatagatctgagccatgaaatgggacgttaatagttttacttggttcattaactggtatacttaacatgtctattttccttgagatgatattagacgttgtataagaagccctgactgttccaccagttggtggcttcaccgttttacagtgataaagcgacactatttatcgcgtgattgtcactttttgtaaagataacctttgtgaatttgggaagtgcttcgtaaatcaaatttatagcgagttaatcgattgcattaataacgtaatgtgataatttaactatccctcagccatccttggccttcaaatccttacgctgctttatccacactcaatatcttggccagcttcgaaatgcctttcggagtgatgcgaacttgagatactgttttctcttcaccatcaggcttaatcacaacagtaaccttatgctcaattaacctctgctggattttttcttgatagccaacccaaggggttcccatgcgacggtaaatccatttgttatgactcatcaggtcaaacaatgactttggctttacctgtaactgttttgcagcatccgttacacacatagaaccgtctgattttgcgatacgctccagtgctgcgacatccggtttcatttcttcgaccttgtgctcaagttccgctttctgttctgctaagtcagcggcaaggcgaagtgcttcgggtaaggattgagggatctgcacctgaacttgatcaaccaacttaccagaacggtaatcaatgaatgtctggttgacctgcaattggaatgatgggcttatccatcctgcgtatgaaacagcgagaagttcatgggcgaaagtgccgggggtagtgccaccacgcactgatttgattacttcctgacctaagcaggaattcttgcttagctcatctattagctcttgtacctgcttattgttcaaccataatgatgggcgttttgcattctccccaccacttgccttatgaagcgcatttagattgaaacgaccttctgagtcggtggtgatttctacacccgcaatgacaggtaggttattatttgctatattcactttgtcactctctttgttagggttgacgtaatctttaattgcttttcacggtttgaagatttagaagcctcgttggtggctgccttcgaggtttcgtctttattgagccacacttcttgctctctcatttacataccaagctatagcctgattcataactgaattcttcgaaataccatcccgttcagataacgaacaaacctgatctttcaggaacttcgttgttcttaactgcattacttcacttttcttttttgcatctacattggcgttcatcacctttttctccccacaaatgatgtcaatatgctattaccatctatttagagataaattagaaggtgataaaaatgacgaaaaagctcgtggcggctcaagataaattcatgcttcgacttcctgatggcatgagggaggctgttgccaaaagagcagatgagaacggcagatcaatgaactctgagattgttcaaattttgcaagatgcacttgatgttagcgtaagtcctattgattcgagcatgtcaccagaagatgcagctgctacatttcaaagtgaagtagaagaatttaagaggctactttctaaaaaagaagaagacatcatgaaggtagccaaagtttttgctcagtgggctgctcagaaagaaaaataattacttagcctacctaatttttgcaatttgctagagttaggtttggccttgatggtcgaaatcttgatcattgaacatctcgttagactgcactataagtattagaaatattctaaataaaacaatgtaatgcggggtaattatgggtcttaaattcagaaaaagaatcaaaatagcgcctggaatatacatcaacatcagcaagagcggtgtcagtacctctattgggggtaaaggagccacgataaatattggtaagaaaggcactaaggcaactctcggaataccggggacaggcctttcatactcaacaaaaatgacagatggtaaacgaaaacagaaaacaaaaacccaaaagtttttttctttcgttttgtacgtgatcctgttcttcttcttttataatcttatcaagtaagccccgtgatggggctgtttagctttcagagagaattattttcactcttttttgcagttaatgagccgcagcattattccgtcgttacgcgggttaccaatcgtaattgttgctataccgtcatggggagaaaaatcttcactaagctcaccatcatcatatttaaacattagctttctgccatcctgtgctactggcagtgcggttaaagccatttcatgtccaacataatcacctgacttcattccattaatgatcataaccccattgttaaaaatcattctggctttcactgtccccagcggaaaagaatattcacttcctcggtctactgctacataattcattagcctgcctactttacaggtgtatattccgttatattcactgtagttatcaccgcaccctattaaggtaagcgctgcacatgctattagtatccttttcataacatccttacattttttgcggtaatcataacagttgattgcttaaaataagcacaaaagccccgtgatgggggttagtaagctacatagataacgcctttaagacatgaaccggatctttctctattgcctttaacaatgcttttgctgggcctgttggctctcttcttccctgttcccaattacgaagggttccaacattaacagagattaatttagcaaaacccgtctggctcaatccggttgcctgacgaatgttttttactttcactgcctcaatagttgtttcacgagaagcagcacgttcgccattcatgatttcgttcatctgtgtcatgctttcagtgagtctggaaaataatttactgtccattgttaccacccctcatttaatgctctcaagactttcttttctgactcgctaaggccatctttaataccttttttataaatcagaagcagtcttatatgtgagacatcgaccttgtgataataaatgacgcgtacaccgccacgtttacctttacctctggatgcccatctaactttacgtaagcccccagtgtgctggataacatcacccgtagcgggattgtctgcaagatattgctgaaactcgcgatattcatcatcacttaacagctctttacagtcttcggtgaatatatgagtctcaatgaatatcatgtttcagtacgccattggtgtatgcatagagtgataatagcactcttattgtataagtcaatagcgtatgacggaagagtttggatagtaaaaagccctgtaggggctgtcctgtatacactgaaatctcatgtaagtctttgattaaacttaattgttctaatgcagaataattaaagttaggttttacaaaagtttcttaaaacctcaaacaagccaaggatgacttaaagccccgtacaggggctattacttattgttattatctgttaatgcattattccaatactttatttttctgataaatgattcatgaacttcactgggcagagtacgctttattgtggagatctcatcttcaaagtcttggtacacgttcgttgagtctggagattgacttaactaccacctactgaagtaggtgggttaccccggatatgacatagcttgtgagagacccgttttttacagtcgagctattcgttatctttcctatctactcaggaaacaataatgactgggaggacacaacatgcagttcaccccatggaaccccaatcctaaagcagcacagagggtcaatgacccgctccccgttcccacccaatgccgacattgccgcagtcacgtaaagatagcccatcacacggaggtgtttgggaagacccggcatgacgacaaatggccgtggttctatgtctgctggtcatgcgatgctcgtgtcggtatgcatccagaaaccgatattccactgggatatctggctgatgaaccgacacggagagcgaggcggagcggcaaacaggaatttgaggagatgcgaaagagagggaattttgaacgcacggaggcgtaccgatggctggcatggaggctggggattagtatcaataaatgtcatttcggctggtttaatgccgagatgtgcgagaaagcaaccaatatatgcagggggtttaaataatgactgattttacatcactggcagatggcggcgaattatcccgtgaaacatgggctgattttgttaaacgcctcgaatatcaacataaaggcgaaggtgttgatcggcacggcacggcgcatccatcatttacagtcagagaaaaggttagattgactggctctgaggatgacgaggtaggaatatattacgattggggagcgtattattccctagagaacgcattagctcatttagatgatgaacagaaacagaaaatatttaattacgcgacagaggaatttttggatgatttagacaatttggacgatatagataaagctaaatgcatcgtgtctgtattagaggactcatatattttctactggaagtacgattacaaaactataaatactcatttaaccagagaagcggcggaacgattcattgctcgtaaacaacatgattatggagaattatctgtttatgttgaatcgttctattggtgctgggaaatgcgcacgttgattgagggagtgttgactaggaaaataaaatacacaggtgatggtaatgacaaataaacgtcgttttaatttgtggcaatggatttggttgcaggtttggaatttatcagaatggagcggaataggtttaggccgttttgcttcgtgggtatttcatcaaatgattggatgcaattatccagttaagaaaattaaatcaggtgataataatgactgattcagatttatgcagagaagcgtttgagaaattcatggttgatgggttcaattatccaattgactcattaggtaaatatgacgatggaacatattggaatatgccagctcaaaattactgggaaatattccaagcagcatggaacgcaagtcgggagaatataatcaaacaggagagccaaaaatgagcaaagatgtgattgagaaaataaacacaacattggaatcagccgaggaatttaaatcggaaggtgccagtacaataatattagatttagatgtctatattacaatattaaaacgtctggccaaatatgaaaatatggagcctgtggcgcggggtcgtattactggtatgtttcgtattatggatactacaaccctaccagtaatagtatcagaatggattgggtttaatgaatcgcatcctgatattgctgacgatatattccccctctaccgccaccccaacaaatagagaaccatcatggatattatcgacacagctaacgatgccgttgagttgacggtatcccatgcgctccagaaccggaaaccaccattaaccagcatcaacggaatgtgccgatggtgtgagactgagccagcaacacacggtgcattctgtagtcgggagtgcggagaggattatgagcgggataggcggagagatggaacaaaaatacagcctgatattggctgatcctccatggcatataataactcagccagcaacggagcagccaacaatcactaaactgcctccctatgcaccagttaactactgagcgcatttgagttaaaagtaccctcgctttttttgggttttccttttcctgcttgtcgaaaaacttaacccaagatgacacgggtatgctggctactggtgtacacaagaattgtgtgtacatcgtgttgtacacgacggacttataaagtatttgagtattaggttttagagtggatgcgtacttatcccaccagtaatcaaggcaatcttttaatgttgcttctccttctgaatgagagaaatacatttttggatcaagcccctttgcgtacaatgagcgcatctcacctactgcgattcgtgcgtccttgagcgacatttcaggataacgaccaacagtaaggcgaacaggcttgccattccagcgatatctatgctgaaatgttatggttccgttcggcgttatcctgacacttaagccgtcaccatcggttaactcaggcgtccctttgtagggtttatcgtgaataccacgtagtttagtgtcgctcaatgccatagctataacctgtacacaagttgaagtgtaattatgtactcaatctgtacacaatggcaagtgaacgaaccgaccacaactaaaaacgagtaggaacaaagcgaaacaaataaaggcaaaaaacttgattaaaacaggaagaaagagataagatacaaacagctcacaacagattgaaacagagtagtaaaaagtccccttagttaaatggatataacgagcccctcctaagggctagttgtaggttcgattcctgcaggggacgccagaatcaagtaatctcgcataacccaccataactaccaactcaaaaaatccttattttaaacggtgttagtgttacccgctgttacccaacataacttgactacaccagcaaaatgtgggcatatttgtgggcatcggttttaatgcccacttaggatgcccacatgttaacgataaagcaaattgagtcagccaaatctcaagataaagcctatcgccttgttgatggtggaggtttatttctttttgtatcgaaaacagggagtaaaatttggcgttttaggtaccgcaaaaacgggaaagagcaaacccatgttattggtacatatccagagatttcactggttacggctcgattaaaacatgccgaagctaaatctattcttgctaacggtggggatttaatacctgtagtaccaaaacagaaagatattgaaactccagacacttttgctgccatatataatgaatggtatcaattcaaacgagctgtttggtctgaaaggtacgcaaaagaattgcagagcatgtttcaagccgacatcctaccaagcattggtcatatgacaataaaagaaatagagccgatggttctactcaaagtgattcgtcagtttgaagaacgtggagctatggaaagagcaagtaaggcaagacacagatgtggtgaagtgtttaaatatgcgatagtgactggcagagctaagtataaccccgctccagatttagctggtgcaatgactggatacaagaagaaacatttcccatttctaacagcagaccaaatcccctcctttaatctggcattatcttcatattccggcagcattatttcgaaggttgccactcaggttttacaatatacagcattgcgtacgaatgaactgcgcagcatgaaatggagcgatgttgattttgataataaattgatcaccattaatgctgacattatgaaaaatagaaaagtacacgtagttcctatgtcaaatcaggtcattgcattactaaaaaccctctaccctattacttccagtatctctaatttcgtattcgctggtagaaatgacaaaaaaaagccaatttgcgagaatgccgtattacaggtgattaggcaaatcggttatgatgggatcgctagtggtcatggattcaggcaccagtttagcaccatactcaatgagcatggatttagccacgacctgattgagcgacaactggcgcatgttgatcgaaatagcattcgcggtatatataatcacgcccaatatctagataaacgtcgaaaaatgatgcaatggttcgctgactacattgatgagatatcgaccgctacgactacctgaaagagaagcaggagattgtagaacggtgagaagggaagctactgtcactataggtcagaagcctgcccttaagatgggatatcacaccttgcggcaaccgtggtgatttccaccctagttgattaactcattgatttatccgaggccgtcactttgaccacccgagacatctcttccgtaaattcgtctttatttcaactgttgggaaaatcccaatggttactttatgtgctggacaaaaggaataaatgcattgtatttcaatgtgttaattgtgcgcaaggggttgggcaagcagacgccaaatctgtcgtctgattaaatatcaatgagttatcgtcaaaatgggcattctcacttaaatgggctttcaaatcccaattggcgcgatcagccaaaaatttgtccgattggaactgagccaaagtgaggacctcggataaatcaaggggttaggttaaaggggggtgtttcctttatgaaaaggcggtgtctgagcgggttagttattatccatggctatatacagtaaaatctctatccagccatacaatgaagaaagtagaatcacgcctataaagcagcgtttgcaataaacataggggcagtatcagtaaatggaggaagttatccaggatctttccaatttcagcagatagaaactactccgaaagaaagtaaccctgtgaggctggtgtctgctccacaccaagaatcaaataagctagtagcctttaccagttatgggtggtatgacaatgatattcagacaggcgtagtgcgaggtggtggcactgatactttgggatatgctgtagacattaattctcggcgagcatttacagtgactaaatggggactaactgtaaatccagatttccaatggggaggtataagtatgcttcgacctagtggaacattctggagaatagagggaatacctgatgagtccgcaagtctacttaatttcatagacagaaacaacgatggttcaaatagaagtgtccaaaccctgccaaacccacctacttcagtaggtggtagttaagtttctgtttctaacaatagaacaaaaagcctaatcagtaacgaacaattggctttaattgcctgtaaaattgctgaacactatcctacggctaaattcatcatctctgcattaccaaatgacattcatttggctgaaaatttaactttacgcattagtaaaaatagtcagattgtaatatctaattcacttaatgaatttttaattttattgaataatatgacattaattgtcgtaggtgatggtggtatctgtcatttagctgcggcattacagaaaaaaattgttgctctgtatggtataacaaaacctgaaaattgggcaccacttgcaacggaagagatatgtattaccttatacgatccagaggatgtcaataatattaatttggataaagttaataatgctattttttccttactggaaaagtagacattttctggatttatcatccttccagagtaaaatcgctaccattcaagatggcaattaaaaattctatttcaattaaaaccataacatattattcattttttattcaaacaagttataaactctggaatcatcgcatttggtgaatatcgccattgataaaaatcaattaatgaacctatgtttggtaaaaaagttaggaaatcaaaagcagccaatgagttattccagggaatactaaattgtttacttcgttcataacagtgttgcacttgtatcatagtaattatggttgttagctaccatcataagaaacaaggtgatattttgtatcaagcactttttttcaatttatttaacaaaacacctgatgtatgttctaattaaacatatagatattctgacgcaataattgattcagttattctctgtttatcactattcagtacaatacattgaataaaatcgataatcttgttaaccaattctttgcattcttggaccttaattcctaaaaaataaccaataacacagataggaagagtataattaaattttttcaaggattcatctgaatttatttctttataaaatattttgcaacaaataatgtattttggtatatctcctacttggtaaaatttgcccatgtctgtgtgacgtctactttcaatttctcatgttaattatcatccctcatccgaacgagtgatgagaaaatcgcttctacacaactcgtttcaatttccttaggaacatcagctgatttttaacgaacagtaaataatttatcagataaaatcgccttaacttcctataatattttaaacttcataggatattctttcatgatccttccagaaaatagacttaattattctattgacaatttcactacttcacttctctgtagaacaaaatattcttttagatacggataattaattttcgatataaaatttataataaaataatttatagccgttaaaattaaaaatcatataattaccaaatcattataatttagatgcctccttcataaaaaaagaaagaataagaacatttataataataacattgataataaggatatttttacaagaaaataatcctggtaattaattacattctagaaatttaatttaaaattgtttttttattgatccacatattgactgtataaaaaaccagtgcaatgataagctagatattcatcataaaatatgaatatcaacatattaattacatcgatagcagtcgaaaaatattcgacaaaaaataaatcacctcgagaaaccaatatgcaaacagtaatcctaaatgaaaaaattcaaattttccgtcaactccatgaggaaggtcgcctaatattagccaattcttgggacgtcatgagtagccgtttagctgaacaaagtggtgccaaagcgatagccacaaccagttctgggatatcttggagcttggggtaccctgataatcaattcgccgatcggaaactggtgatgaaagcgctaggtttaattacaggctgcaccaaccttccagtttctgctgacattgaagatggtctgctgggcattgatgaaaatatggatcatcttgtacaagacttatattctgtcgaatgtgtcggtattaatatcgaagatgctcaaaatggtaagtcaatgtctatagaggatggtgccgaacgcatagctgctgtacgtacttccgcgaataaattgaattacaatttgtttatcaatgcgcgtattgattcatggcttcgtggtgaaaataccgaaccagctcacttgatttcccgtgctaatgcttaccttgccgctggcgcagattgtatctttatccccggtctaaccgatttagctatatgccaaacgatcagtactcatattaacggaccgttaaatgtaatggcacactctggtgctcccagcgcagaagaattttttgcggctggagtgaaaaggatctctggcggttctttctttgctgaacaggcctatggcatcactttgtcaagtatggagaattttgtacgaaatggtatgctacagccaaatgataaggcgaaactgaactatatggcgctaaatgctctattggctcagaaagaataatcaatacgttgcaggaaatatggcgttctatcctgcaacattaaacaacaatctaaaacacttagaatatagtttcttatattacaatttaagtatgaaattaaaataccaattttactctattaataactaactcagaaaacagtacaatattaaaaaatttcaattagataaaaataaaataaattcctcttgaaaattcacacaacttagaaacataatctgttttcaaagaggtcatcttttcacaaaagacggactttcgagggttaggtattttatacctgagtgtatgtcttaaacatcagataatggcatctggtatgagtcaaacgttaacttctcaatctaatttacaagataatccctgtataagctgtggtgcttgctgtgcatattttcgtgtttcattttactgggcagaagccgaagatggcggaggtactgttcctgtctctatgaccgaaaaattaaacgctttcatgagttgtatgaaaggcacaaatgaacctaatccccgctgtataaatttacgtggtgaaattggtcaatcagtctcttgtgccatttatgataaaagaccttctccttgtagagaatttactcaagcttgggaaactgacgattacaatgaagcctgtgatcgtgccagagccgctcatggccttccgccactgccaaaatcgtaggcctaattcatttttccattacctgtcataacttataatgacaaataaaatagatcatttaacaacctgaaaaaagtatcgccattgccagaaatccttattctaaacttctgctggatatctaaggcttttttgataacagaaaagacaactgattcattaatattgttatggataaatattactatgaggaagtattacgatgagaagagttaagacatttagatgaagtggtgggcgataccagattcgaactgatgaccccctccttgtaagggagatgctctaccaactgagctaatcgcccacttcatggtgggtcgtgcaggattcgaacctgcgaccaattgattaaaagtcaactgctctaccaactgagctaacgacccgactaggtaattctgattttatatctaaatggtgggtcgtgcaggattcgaacctgcgaccaattgattaaaagtcaactgctctaccgactgagctaacgacccaattagataattttgatttgatatttaaaatggtgggtcgtgcaggattcgaacctgcgaccaattgattaaaagtcaactgctctaccgactgagctaacgacccattttaaatatcaatgtgatactgcgaaacaatctgatgaagtggtgggcgataccagattcgaactg

SEQ ID NO: 16890 - DNA, 828 bp, Xenorhabdus bovienii
  unsure (1)..(828): unsure at all n locations
acgatgctttgagcccttcacatcccnccacttgtcgcccactgatcgaagccagggatcancatcngtacgttcaatacaagccgatacccgcccagtcatgatgagtttaccgtacaccagatcacatcacagcctattggtgttgtgactatctatccgggattatccagccaagttgttgaaaatatcctgatgcaacccgtcaaggcactgatattgcgctcctatggtgttggtaatgccccacagcacgctgatttattgaagatcttaagggaagcgactgaacggggtattatcgtggtcaatttaacacaatgtatttctgggcgagtcaacatggaaggttatgcaaccggccacgctctggctacatcaggtgtaatcagtggctatgacatgacttttgaagccacgctgaccaaattgcactatttattgagccagtcctatgaatccgaagagatccgccacctcatgcaacagaatctacgtggcgaattgagctattcagatgaataatagaaaaagaaatcggaggtataatgaaaacagcactattacttatcgacctgcaaaatgattatcgtgatagcagcgaaattgaggataagccagatcgagtgtggcgtggggcgaattatcaccatgctccggccaatccactctctaaggaagttgatgccaatctggaaaaattgggtcaggaacttctggagcagtttgatgcacaagcattcatgctgcgtttatacgaattattgccaatcaacaatcctgcttacaaacagctggctaatctattgatgcaaccagaaaaaggcg

SEQ ID NO: 16891 - DNA, 949 bp, Xenorhabdus bovienii
  unsure (1)..(949): unsure at all n locations
agggaacganggtaggttttttgnnangaacagtgtcatacatgcaggttttttttcggccgggaatttgcgctgccatgccttgtttttctgcttgttaacaacggtattactgtcatagccccgatccgctaataaatgttctgcatctattccgtcaatcaaggcctcagcttgtgagcaatccgctgtgggaccgcttgtaataagcgctctgatcggcataccatgcgcatccacggccagatgtatctttgtattgagcccccttttgtgcgccccatatcctgattgcctcctgccgcccctgcggcgtggggatgaaccttaatatgactggcgtcaatcatcagccattcgaaatcgggttcaaagatgagttcttcaagcagttcttcccatacgcctttgtcccgccaccgacaaaaacggcgatgcgtatttttccagtcgccataatcgggcggtaaatctcgccagggtgcgcctgtccgtaaaatccagaacacggcattaataaataatcgattatcataagcaacacgcccccaggctcccttacgtcccggcaggtgaggttcaagcaaactccaaatatgatcggaaatatcgtgacggcggtgtacgggtgtgctcatggttaagtcatccattcatgtaatatagggttattattacatgaatttatttatgacgacaccatctaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16892 - DNA, 179960 bp, Xenorhabdus bovienii
tatttcaacaagatgaactatattaatccgattttttcctgtttataacgtgaaagctgctgctggctaatgccaatttttttcgccaatgatgttgctgtcatactcaactctttccttttggcctgaatacgttgtccgactaataggttagcttcttccatatcttatcctttcaatttaaatcagtaagttatggcgttatcaaggatagttgccctggagcttgaataatggcttggcttttacctcaccatttgcgcctattgttacacctgattcgccgttttgttttccgacatgcactttgttttttttaatggcatgacttttttatgaacgtgttgtaaaagacagtgcccttaccaagtaaaggggttttcttctatgacacgaattgcattctttgttttggtgtcaccttgcatctttcaacttcctcacctgtcaccgggttaaacagcatttttattctccttacacgagggataactaacctgcttcctaacttttttcttatggtaatttatgtaattttaaatttattaagatattgaatataaaagaaataaaatagataaataagaataatctgtaaaaataattaatacagatttaaaggcgaattattggatgtatattggttctattaagacctttcttcaggctagaaactggacaaaatataccaaactgtaaacataatcctatataacatctcctaagtcaaatttcgttacatattacagctcattccacttaagcaattataatccatgaattttttttgttattcacatatttaatctctttgcaatagtattgatggctaaaaatcgttacttattggcatccaagtataatcaagctaatcagaattaatattcttttaaattgacatatccgaaattaaattccattaaattattttcaaatagattataaatctaaactagacagtttggtataaaatgttttgttttttaacaaaattttatttatttaagttagttaaagatatttctacattttaatggattattatcgcaaatttttctgatttttattaaaaatatcatttattgtcattttttccactaaataatctttcagattctcaaaaataatggcttactcgcactttggggtattatcaaaagatggccgttttttcgacagatatggatggtgatttattattttttcaaataaaaacaatatgataattatttttttatgataggatcattttttatcaagtgacattcatcctgctccatattccatccttgaataattacacctttgagcacgtttttgtattgaactctccatttgtataagaaaactccaatttttacatagtggtctgaggtgtccttttattcatggttgcgtttttatatgaggaaatgacggaacgtaatatggagcctatataccatgccagatcacaatgaaaccttatctgacaaatggctggatggagggatattttttttggggggggggtaggtaggaacagatcttggaaatggaattattcccttcatctttcaaatggcggctttattggcggctttcactcaccccagtcacatcgttatctatgtaactggggattcactcacttgccactgcgctgcatattgcttaacgtggcatgctggtcggcgatatcgacgtccagttctctcagccgtgttgtcacccacgtctgataatgacaaaagtctacctttcggcacaggcaaacagactttgctgatgtagattgtgggcaaactggcaacttaaagccagttcttttctactatgtccccgaaccagaagcacttcccaacgatgatggtgaccaggcacaaatcctgtgcaggcaaatccggcttgctgcaaaatttgtaccgcgtggagagtctcttctccgaccggcagtttcacatatatcagcttgtgcgccggcagttctgtcacttcttttacccgctccgttgtctgcgtttctatccagacttctaatcggccaccatgactggcgatgctaatacccgtatctattggaaccgcaggttttagcggttcttgaccaaatatttgagtgaccgatgtcagccacgtttgccaatttaccggccagtgtaattctggaaacggccagcgttgcaaaggcaggcaaccgagtacaatgctttccggacgtgcttgatcaaagggagatgtcacataatccggtaataaacccgtggtgtgaaagcccaaattttgagccagacgctggctgtgattatgcgacgatacctgtttaatcgtgagtatacccaatcccatttctttggcttgatcacacaaatatcggcccagcgcggtcgcaataccctgtccgcgcgcttgtggatgtaccgcgataagcgcgagctctgcacttgatgggcaacgcccattccgccacaatgtcgcgtgtcccaatacttgcccatcctgtattgcaacggcagaataccagtgtctggccgcattataacgactcagcatggttggtaggtagacttccggatagacgtaatcttcgccgtaaacgactcgaaacaacgcgctgactccggtggaatcttcttcccggaataagcgaatcaacggcatgactggatttatattcatgctgtcttctcttcagcattataacaacgatgatccacgacccgtatcagcttgccggaacgtgggtgcgtgaccatattttccagagcgcaagaggctacctccacctgtaacaccccttggctacagagttctgccatagcgggctgggcagtgactaacgcctgatggattgatgctgttgatggcatctgtggtgagtcgctggctaatagcagttttatcttatctatgccgtcctgacggcttaacaatagctgccaagccagtattcctttctgttgttgcagtaaacgggcaatctgatcgggaaacagggataacgtggaaacccggatacggtgagcacttccagcccgaccctgcaaagcaaatttgcggttcagtcttcccggctcttcacaccagcaggccagatcgcctgtggggtagcgaatcaccggcattagacgacgttgtaggttggtaacaactaacatgccattgcgtccagactcagtaatgggctgaccattggattcgtcaataatttcgacaatcgaatcttcatcaaaaacccgatgttcaccgtggtgacaatcaggagaggcggcaccaatcagacctgcgtcaacactggcacatccgattgaaccaatgcgcgcgttgggaaacacgatattcaaaagagccagttgttccggaaacaggctctctccgccgtacaacagacgatcaatattgggcataaactggcctgaacgctgcaaggtactggcaaaacgcaacaattgtaccggcactcccgccagtacattaatccctaagctaacaatggcgtcagccaacgcctgatcatcgactgaacaggtaaacggatattccaccaccggaaccggtgaatgagataacgctccgtgaataaacaacaggctggtatacagatctccggcaaaaaagagattggcaacacggtcgccagattgtaattgttgtgcaagaccttggccgaacgaacgcacaaaggcttgccattcgctgcgactgaacaccgacaacctcccttcgctggtagagccgccggttttaaaaatatggccactgttgatagggccggtgagtaccggccaattctccaatggctgcgattgctgccagtaagcagcaggatcgattaaaggtaaatccgttagtgcccagccggattgtggcaaatcattataaagatccctaaaaaagggcgcgtggtgacgggcgtattccactagatcgtgtaatgataaagtcatgattagctcaaaagtcgttttgaaatctattgggtatattgtttcagacgcgataatccagcactaacggcgtcttgccactttgggaatgacgacggaactgtccggctggcgtagacgtgatttccaattgcaacaattcaccactgacaacctgattcagcatttcatgttgcagtagatgttgacgtacctggttaacatcgccatcagccaacacatggatatattcgccacccttatcgagatttccgactaaccattgcaccggaaacgccagatcggctgacaatgccgttgggttcacaaaaatagaacctacccgtatcaatccaccatgccggccttccagtctaaagcgtggtgtcgataatccgcaggtacaaggttccgataaccagtggcctaaatcgcccacctcatagcgttgaacgacttgtccttcccgtgccagaggggtaaacaccagccgacctgtctcgcctgactgaacaggttgttcactgtccagatctaatatttccagccactgaatatcagataacagatgaaattcgccctcgttgcaacaagtgcaagcatgacccaatgggcccgcatcaacggaaccgtaaattgctgaacggatcacctgcacgccaaaactggataagaattgatgccgttcttcactgacatgttcaccaccggcgaaaattttgcgcacaccaccataagcgcgtaatgcggcctcttcacgttcaaacagctgatatatcgtgcttggcattcctaccaacgtattaacgccttgcgtgacaataacttgtaggatctggctaaaatcgtcgtctatcgggccacccatcgggtaatgcggcacggacaatttatccagaacagtgaaaaagctaagtaggccaccatacaaattgccgccgtacaggagattaatgacgcgatcctgtgccggatcgagaccggcagaaaataggccatctgccgctgcttgcatttggatgtgataatctctatgactgaatcccgctaattttggcgctcctgtactcccgccactgcggaaaaacacttgtgctttcggtgtcgtgccactttgctgaaactgttctttgcccatgattggcagccctgccagatccggcggcctgatggataatttatccagcgtgacatggtttggcagttgctcagctttcacactgactgagaccctgcgtgcaagccgcgtcaatgcataaacgccatcatgaggttctccttcataaccctcatgcatagcgccggcctgacatatccggctgacacccgccgccagcaactgacggctcaaggccggcaattcgtgttctccggcgatcaaaccacaactctgtaaataggggcgccacggcagcaatacgttgatcaactgcgcacgcggcacaggacgaatttgcagagtacggtacagtggagatgccgccagttcctgacgttgcgtccacgcgacccgccatcctgtgccttcagttaccgaaccggcaacgtcggcaaacgtgtgatccaagcgcagaaatgccatctgactgctgatttcagccgcttcttggatatctggctgtaaggccggccataccggtgcgcgtcgttccagtgccgaagccacggcatcagccacttcgcgcaaaacattctcgtcggtactatctaccaacaggcactgtgggctggaacaagcttgttggtcaaaacggcaaacatcatcagccagggcatcgtagtcggcgttgctggcgaccattgggtcaagataggcaaaactgatgcgatgcccccaatcgatccagcggcaacccggtcgtaactggctgcggatagccgtcaatgcggcattgctgccccaggcagacacggcatcggcacaggcaagtaattctgacaattgatcggacggcagcggtaatacggagacgtaagacgctaatttgccactgagatcatggcgcagaaattcagccagtatccgtgcattgaggccattatcactgctactggggcgcaaccagttgatattgccaactaacaaactttccaatacagccataaatggtagcaatggtgcgttggccggagtgatatgcaccaccaaccccaaaggttgccaagtctcaaagcgcggctgggtataatcgaaacggcgcagggaaaacggctgttctcccaattcatggcgcagcttttcttccagtgcgtcacgacggcaaaagtggtgtaaggtgctgattgtggttgcatccagtgcaaaatcagttgccatagttttgagactgctggcaaaacgctcggcgcaatccaacacctcttgcacagttggaggacaagccaaggcatcggcaagacggtttttaagatcggccaatgcggccgccggttccaagttagagataacctcaccattaactaaatacatttcaggattccttaatcaactcagaagcggcaatcgcacaactacggcttttactcgtaccagcacggcccagcagttcaaaccaatcggtagctaatccacatccacactctgcggcgggatgcaataccgccaaatcgctcaccacgatactgtgtgctggactggaagtgatatagggtgatgtcagatgcagaaaacccggtttaccataggattgcaccgccatattggcggtatcacggacataagcacgggcataggacggcacatgaaaatggtgattctgacactcaacataaggtacaggatgctcaactgaaccatagccatcccggcagcgttcatcaggaatgcccagttgttcattcaagcgctggtacagcagcgatcgtggaatggctttatcggcgtgggttttccagccaccccctaaaaagaccaaagattcgggatgcaattgtagtgggggtaaattcatttcccgcatccgttccagcgtgaaccagaggaaggccgggaagcctaagaaacgcactggcagcccttgtgcggcaaattcctgcaaggcacggatcacaccaaatgggtcgaattcattgctttttccattgtggcgcagtgcataacaagcttgcgataccggtgcgtactgacacagatattgatcggtataggcggttcccagcgtaattgctccggcgggttcatagctcaataatatgtagttacaaggctgttgtggtgtattccagccgtaatattcgaaaatacgttcaaccattctctgggctgcctgtatgctgcgcgtatcgtaccgcatacggctcttttgaccggttgtcccagatgaagtcaattccagcgcatctataccggtgtgacttagcagcagctgatgtttgaaataattggcgaaaataggtggtaaacgcgaccagtcatgcaatttttctagttttttatcgtccaaaccattcactttcaaccactgatggtaaccggggctgttttcacaatggtatcgtgtcaattcacgcatagccgcgtcgaatagttggtcacaatcgctatcggcacgataggggtgatcaagcgcgcaaagggcgtcaacataagcaagagaagtcaaaagtcatctccagaaaaagaaagaaaaaaagggtaattcccttcaataataagtaaattgctttaccatccagcaagcaaaaggactaatactccactaagagaaaattatggcatggcaaatacaattacttgaccaaataaaaataagctactgcttttagatatttaatatttgaaattgttaattccttgtgaatgaaatggggtaaatataacaattagaattttataaaattccatatcataaatgatgagtgttcaataaatttatccttgaactcatctggaattagtgatatttaaatggaacaaaaaataacctaacctcatagtttcgtctaatgtttatccaataaatgaaattataaaatctacgaaaattaatatctgtaatgacaaatgataacgttatttcattaataaatagaaattatcccggcaaggaatataataattaaatgcagggagtaatatttttattttttaatggctaagttatttttaatacagagaatagctaacatatcctatatttctattcagtgatgaggaatattcaaaattaatcatggcattatggtaaacgaaaattgagaatctatatctaatattttaagagtctaagaaacattttttgatattgctaaaagtaattaacatagagaaaaaaataaaataatttaaaaacaatcacttagatgtaggtgttgcatatttgtggtttgttttttttattggttgataactctgtttaatatcatgaaatgcccaatatcaaactgatattttaaatattaccgcaatttttcgctgtttattgtcacctaacgtagaattgtattggattattatttaatttgaaattatttaattatgtgattattttatttagcatttataaaatatgttttgggtattggtttagatccaacagaatgatggttttctattctatagaatttacttctgtcattaaaaagggagagtttgttaattctcccattttctatggaagtcagaagcgggatttaagcagctcgtaataaatactgctattggcatgtcatcgcctaattccatatcgggtctttcgtgatgataaagtcattgccactttgttgtatattcttgcaattcattcaatgatgaaaataagtattgccccagccagtcataacgaacggtacggttataacgttcagtatagaccccgctgggcgacagactagtactacagccgtaattgctctgtaagccgatgatttccccggcggcgacagtgacattgttgtgcccggtattgatgccgtcgtcgccagtctgaccaatgtaaaatctgttcgattgtctttcccgctttttccatcagctttgacagcagcttacggagttccgctacactgagcggaacccggcctaccggtgttttttttctcctgtacccgcaaaaccgccaggactgcatgggccagtaacgacaaggtaatatgccggtgccagctctgccatcgccgcacttcgtagtgatccagcccacattcccctttggtttcctcaaagccactttcgatttcccagcgacaacccgcaacctgaaccagcgtattaagatccacctgttctctcagggcatacaccacatagtaagcccgttcctgtctgctatcccggctgcgccgaactaacaaataatgaccataatgtcgatcctcttcactgagctgtaaacgccataacggcacgacagcccagtcatactcacgctcaccttttgtccccgttcccgctgaccgtgttttccagtcagcggcggtcagggtatcggcaatccggtcaacacggatatactctggccctcgccaccataagggggtattgcagggaatggctaacacaaagggctagtatcgggactccagccagactcttagacgacggtcacggccataaacttcatccgcggtcacccagcgacagggaacgccggcatcccatgttcgttccagcatctgccgggctaacgggggtttcgttgcaaaagtgacgctggcggggatacccgcggcttcacagcgggaacgggcatctgtccactggcgaggcaggtataatgcccggtcaacaaaggcatgccctccgttgccggcgtaacaaagaaatacgcctatctggctgttttctacccgtccagcggtcccactatactgacgctgtaccccggcagaatgtgtcccttttttgataaaaccggtttcatcaatgatgagaacaccctgttcatcgcccaaatgttcagtgacataatcccgcaggatatcgcgggccatatcgacatcccaatcagcgcgttccagcaaatattgaatcccatcgggggtattttcccccatccattcagccagttgccagctattcttacgttcaacatcactgagcaatccccgaagataggcgaggctgcgttgtcgtgagccggtagagtgaaataagggagccagacgggtatgtaatgcctgtagcgcctgttcccagattttggcaggggatggcatgtgacaccgccttttatttaaggaagaagagccctatcatggcacatgatggattacggctgtagtattaggctgtgtcccttaatgtaaattgatagtgttctcatctaaactgttttcaatatgggaaaaagatgatggcacgctacgacattcctgatgacgcatggatagtggtagaaccttgtttgcccccggtccattcagagcgagcaggacgtccacatgttgaacaccgccgtgtgatgaatgggatgttctgggtcttgtgctccggggcaccgtggcgtgatttacctgaacgctatgatccttggaaaacggtctataaccgatttaatcgcgggtcaaaatcgggcattatcaacaagatatttaatcggttactgtccattctggatgaaaaaggcttgattgactgggctgaaatttgcctggatggcagcaatattcgcgcgagtaaagatgccgcaggcgcgaaaaaaaacatcccgatatcaccgacgatcatgcgctgggtcgctcacgcggtggttatggcaccaaaatccacctggcaaccgacggaaagggttttcccctcaacctgatgttgaccgctgggcaagctcatgaaagtcaatccgccatccctttgctcgacggcattggtatacaacgcaaaaatggtttcatgaaacggcgcggcaaagcggtgctggcagataaaggctattcgggcggaaaactccgcggttatctgcgtaagttgcggataaagagcattattccgtataaaatcaatgaaaaaggcagtactgatggtcgcacacaatttgatgagcaggcttatcgtgaccgtaatgttgtcgaacgttgtttcggttttcttaaaggaaatcggcgtattgcaacccgttacgaaaaaaccgcacgaaactttttgtccagggtgaaattaggctgtattcgactcttttacaggcggttatctaattaagggacgcagcctagcggtaattgtcaacatagttggtaccattaatgaatttaagccacgcgtttttctcgttcgggattcaacgtcactgtttctacccattgccagtttcttgtgcttcgcgaccagcgttccggatgtatgagcttagcttgacgataaacggcatcccgctgttttaaaatcattttgtcttcgcctctgtgccgttgaccgggtgtcacataatttatcccactatgacggtgctcttcgttataccagttggtaaaattattcccccagacacgcgcttgtgtcagatctctgaagccaccttccggccacgtcggcacatatttcagtgtccggaacagcgattccgcataggcattatcattgcttactcgtgggcggctgtgtgatggcgtgatagccagttcctgcagtttgacctgcagggtttgtgatttcatcgcggcaccattgtcggcatgcaatatcaggggttcacgccagcatttctccttccagactgtgcgctgcaccagcgtcgccgctaactcaccactctcggcttcatggacttcataacccacgattttccggctgaaaatatccattatcatatacagataaaaccagcgacctttgactgttgacgggagccatgtaatatcccacgcccaaagctgattgggggcggtggcttcccatgtggtcggtttccctcgtttgtgagctgtacgctttcgcccccggtgatgaacctcaccctgacgccgtaatacccggtaaaaggtggattcacacgccagataaacaccgttatcggccaatcgtggcacgatttgggaaggtggcaggctggcatattccggctggtgacaaacggccaatatctgttgctcttcttctggggttaatcggtttgccgacttaggccggacagccaacggccgccggtcttccgggctcttttgccagcgccgccaagtgcgcaggctcaaagggatctctttaagcgcgaccgtcaaccgggcacccgcctcggccgccttgctcaccgcatccctaatcccctgacgatccgcaacaccggtcagtcttcctcgttgtccgtcccgaagtgtgcctgcaacatctttcgcaaaaccagtatcgctgccgcctccgccagggctttttccttacgggccagttcacgtttcagttgtttgttttctttctggctctgttttaatgccgccttatcgtcacgggcaggcacttgtaagaacgcctgtttccactgctgaatttgctcaggatagagcccttttttacgacaatattcggctaattcagtggcactgaatgtggccgtttcaataatgaccgccagccgggcttctgcgggccattgtttaggagttttgtctgcgccgggcacgggttttccttctgcttttgcctgattacgccaattatacagggtggcttccgatatgccttccatctgtgcaacggcggcgacagtcatgttgtacggcggtaacaatttagccagcgcggcagatttacgctcgggtgaaatacgagtcatttttttctctatcagcgttgttaatggggatgacaactatgctgacagaaagggaccatcagaagatagcaatgaagttaaggaagtaattatttccttaatttgtgtgataattacactgttatccataccttcacggggtatatttgcttgtagttttacatcccccaataatccgcgaattaatgtaatttcatcaagagtaaggcagctttcatcaactagctgcttgataggaaccgtaaggtctcttaaggttagaatatctaacttaagtatttttgcaattaatcttcctaaatcagcccaatcggttaaaaaagaatacactcccccagatttaattgactctgatggagaactagaagtactaaatccagacatggcttgtactcgaatggaccattcaaaaccagtcaattgaaaatcaagatccgatgaataaggatccgttagtatagcgtcatcatccagatgacgatgtaataacccttgtgagtgtaacaattggagagcatttaccacacgaataatattattccagaaacgaattcttttttgtggttcttttagttttttaagttaatcaatgaaattatctgcacttttgttatagtcggtaatacaatacactgacttaccgcgtccactaatgaaatcgaagatagtcctttctgagcctgaacgaatcacgttgcaacaactcgccctgaatcatcagcatcgggacatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatgaaacggagttcgctaaaaaatccgtcttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttgattacttaagccaatgtatagatagtgttcgttgttgtataggtttctgaagaaagtatgataaaggtaggcgattacctgcatcaagaacaaggtaaaagccatattcatctttgcctgtatcgattaaattcgcaatatagtctcctaatccgggataaccttttagtcgacgtaattgacgaatttcatatagccagatatcttcaagaatatccgatggttcgtgatattcatgtggccaatattttatgataacaggacagtcttttaagctagctgtgattaaagttggctttccttgtatggagttagcctctttaaaagtatataggccttcgaatttttttagaaatgatgactgggaccaaacagacatacacttttccttatgaatgagaaaaatctaatactaatatttatgaggttgattaaaaagtaatttctaaaaaacaaacgaaactataatatattgaaaatattaatatatataataataaaaaattgaaattaaatgcaagtaccttaaacttatacctacaaccagtctttatataacagacatgtgaaaaatagagtgtagtttttgataacaagtatggccgctactgcaatacggccttgaaataatcatctcatctattttcttattgctacacctaaaataattcgataacctgattctgttcaatcaccatcacagatggtcaccaatgcttccataggtctgagaggaagcgctttcgagcgactagaaaaactcctgtagcctgaaagggagtgcaagaattgtggtacatctgcgcacttttggaagcagatatcgccaatatgaacatcctagctagttcggcgatgaaggtttttttaacttaagagtaccaacggtacttaggcgcgttaggttatggtttccatttcctttcgtagctgacgttgaggtggggaagatccacttcggttttatcttaacttcaagtgggctgaaacacacgctcgcttacttttcacattagcgttaggtgatagcctttcgcccaatgggattgagctgcgccttgatctcatttcacttcaatgagcaggattgctttcacgcatccagttcatgcttagctgtatctgcttgaaatattaagcggacagtttttctacacctaaacaattagctcattgctaccgtttgacacttaaccttgcggggttttgctgtgcctgctggcatttcaacgctcgcactacttttgctgactgtttgcgggacttaaggcgtcactttttgcagatttaccgctgaaagtgacgccgcagcaaaaggacaacatgactatgacaggctcatgcctgcttaacagcgcagtgaatctgacactgcatttcatagattaaaaaagcatcaaaaggagaacttgacgatatcgaggctggctttttgccagtggggatgacctgtttatgcaggcggcagtacaacgtactcaaccgataccccgcaatacctcaacccgcgtttactctggcgcacagatatccgtcaaggacaaagcaggcgtttcctgttttgtcagcattgtcgcgcgccagagattgcatgttgtcaggtataagtagggagagaagctaatgagccgactgattaaggaattgaagttttttgcccggcagggtggaggcagccataaaacctgtcatgaccgcactcggattgcagggcgtttgggcgcattgttattgagcctgaatattcaggttaaaagtcttagccatttgaaagccaaacatgtggaacattacgttgatgcccgtttatctcaggggattgctaaacgcactgtgcaaaatgaaatgtctgcattgcgtaatattttccgcatggcaggcagggagaaactggaaacctcacctcgtttgagcaatcaggcattgggattaagcggaaccagccgagccggaacgaagcagacgatccctgatgctacgtttcaggttgtttatcagaaagcacttgaacatgatgcaggatttgcagtcacactgaaacttgcccgcttgatgggtttacgttctcaggaagcggtgcaatgcagtgcttcattgaaaagctggcggaaacagttagagcaaccggagccgaaactgcatgttgtttttggtacaaaaggcggaaggccaaggcaaacccgtgtattgaatgtcgctgcggtaaaggaggctgtagagcaggcaattgctattgcagaacaacgaggtgggaggttgattgataaaccagatctccggcaggccatgaactactggcggacacataccaccaggattggtttaacaggccgccattctccccatagtttgcgctatgcctgggcgcaggatgccctagcattttaccaacaaaatggttttagcaggcaggaggcaagggcactggtttcaatggatctaggacatggggatggtcgcgggcgttatgttgagcgggtttatagtcagggaggtctggaatgatggaaactctgacttttattcgtctagactatgtaatgcagaagaccggactagaaaaatcacaaatcgaccatttgattaggcagggaaatttcctcaaaccgcgcaaattgggtatccgttctatgttatggatagcagaagaagttgatgagtgggctgccaataaagtcagaaaaacgacttaacgtgttgagttagtgattggggttagtgattcagttattgagtcagataaaccaatcagttaaagtaaccgctccattggcaaaatccaatggtcagggatttgcaaccctgtagagctatccactggtaggatgtttctaccagtgtgcctgcgttcgccttttctatggcggttcaggtaggggaggcttcggcctcgccggacgatagctcccggtattgcaaaccctgtctgaatcgccaccatcaatcaatggaagaggtagcaggaatgattaatattcaaaacgactggcattccgccgatattattggtgcattgcgtaagcgtggtacaaccttggcggcagtttcccgggaagcgggactaagttcttctacattagcaaatgtattaagtcgtccgtggccgaaaggtgaatggattattgcagattacctaggaatacacccttcagaaatctggcctagtcgatattttgataggaatggacagcttattgaaagaaaagctagaaagcagttagttttgtaggaagttcttaatcagaaaaaaagtcactatctgaaattttaagctctgagataacaaagaaaccgtttttgttctcatggctttttctttgttttcaagtttcctctcgttctgttttctcattctccccaatataaacatttttccgtgtataaacatttgtataaacagaaacaaaaaaaagcacttcccctaaaagaaaaagtgcttttataacaacatgatctaagactaggatcagttcatgccgtattttttcagtttcttacgcagagtaccacggttgattcccatcatcagggctgcacgggtctggttgccacgggtgtattgcatcaccatgtccaacagtggctgttctacttcagccagtaccagctcatacaggtcattaacatcttgaccgttcagttgagcaaaatagttcttcagtgcttgtttaactgagtcacgcagaggtttttgagttacctgatcttgtgaatttacagtagcaacggttagtacatcagaatttacgcgttgttcgaacatagttctgtcagctcttttctttatttacgcaaaaattttcgaagtatgcctccaacgcctccagctgttcgctggcatcctcaatggcgttgaatgtgcgccgaaactggtcatcaggagcatgttccttgaggtaccaagatacatgcttgcgtgcaatacgaactcctttgccttgaccgtaaaagtcatgcagttctcgtacatgctcgctcattaaatgctgcacttcgccaagaggcatcggtggcagcaattctcctgtttccagataatgctggatttcccgaaagatccagggtcttccctgagcagcgcggcctatcatcagggcgtcagccccggtgtattcaagcactgctctggctttaagcgggtcagtaatgtcaccattagcaataattggaatggcaacagtctgcttaactgtccgaatgttatcgtactcggcctcaccattaaacagacaggatcgcgtcctgccatgtattgtaagagcctgaataccgcaacgctcagccaattgggcaatttctacacagttacgctcttccggtgaccatccagtgcgaattttcagtgtgacaggtacatcaaccgcgttgactaccgcagaaaggattgcttgaaccaattccgggtaacgcagtaatgcagagcctgccagcttacgattcacctttttggctgggcaccccatattgatatcaatgatctgagcgccattggcaacgttgattctcgctgccgccgccatctcatcaggatcactgccggcaatttgtacagaacgcactccagattcgtcgcgatgaaccatacgcagccgagatttatccgtcttccaaacctgtgggttggaagaaagcatttctgatactgtcattcctgcacccatgtcatagcatagcgatcgaaacgggcgatctgttatgccagccataggagctgcaataagacagtttttcaactggtattgtccgatacgcataggcgaagaaagagtggccaactgtgactaagggcgcgtatattacgcatttttcacaagatatgaaaggccaaactttgagcgaatcgatatttataacagaatttttccagttgattttttaaaaattagtcaattacttttaaataacatcaagttacatattattgatgaaatttattgttacctgcatttatcatgatgaagagcgcggattaccaccaattaacccctcagatgatcattttagtggataatctcgcttttcaataggcatcaagtgattattttttaatcccagtaatgcggcaccactcttcctgttctgcaatcggatcgataataaattcattgctgtaggcttgggcaacaccttctgcctgacttgccaatacgccggacaagcccaatagcccaccagatttaggtaatgagccaatgatcggcgccaattcacgtaatggaccagccaagatattggcaatgacgatatcacatttgaggtctgctggctgatctttcgacaaatagagtgttaattgtgcggatacaccgttgcgttctgcattatcccggcttgcctgaatcgcctgtgggtcgatatcaatgccgatggcatgttttgcgccgagtttcagagcggcgatagccaaaatgccagagccgcagccgaagtcgataaccgttttatctgtcaggtcgaggccgtccagccattgcaggcacagggaagtcgttgggtgagtgccggtaccaaatgccagaccgggatcaagcatcacattgacggcatccggttctggcacttctcgccagcttgggcaaatccacaagcggttgccgaaacacatggggtggaagttatccatccattcacgttcccaatctttatcttccagctgctcgattttatgaaggaaccctttgccaagctgtggaacctgctccagttggctgactacggctttcatatccatttctgcatcatacagcccgataacatcggtatcgccccataagcgggtttctcccggcagaggctcaaaaatcggcgtatcgtggctgtcctgaaaggttactgacaccgcgccgctttccatcaactcgtcaccgagtgcttcggcctgttgtcccgtggtgtttaatcttaattgtatccaaggcataaaaattctctttctgtgaatcaatttcttatgaaaatgaaatgatgtcgccgttattgagatgcggcggtttgctggcatttacggctgccaatcatattccctatcccgaaggccagtaaactgaataacaacgatggcactatcggatggaagccaaaaatctggatattgaaactggccagcagtgtgtagctcgtggcaccgatgatcatcgagccgatggcaccatatgcattggctttttcccagtatagccccagcaccagtggccaaaggaataccgcttgcagcccgccaaatgccagtagattcagccaaatgagcatttcaggtgggcgccatgcggccagcagcagcagcatccccaaaaatagagtggagtagctggaaatgcgagagagctttttctcttggctgatttgctgggggaacagatttaaatagagatctttgacgatagtggccgaagattgcagcagttgggcattaattgttgacatgatcgcggccatcggtgccgccagaaaaataccggcagcgacaggcggtagtacggtgatcatcaaagttgggatcacttggtccgggatggtcagatcaggaataatcgctcttcccaaagcgcccgcaaggtgcataccgaacatcaggagcgccatcacaatagtgccaatgataataccgcgatggacggctttactgtcccgataggaaatgcagcgaacagcggtatgtggcagcccgataacaccaaagcagacaagtacccagaaagacgccataaatggccctgtaaggatattatcagcaccgtagggcgaaaccaggttgggatcgatggcgcgcagtgtgtcgacggcttttgacaaacctccggctttgtagatgatacctgccagcaatattacggttcccagcagcatgaccagcccctgtaaggcatcgttgaggacactggctctgaacccgccaaatgctgtgtaaagcgcgattgaaatgccaaaaatcagtaatccggtatcgtaggggatacctgcggctgtttccagtaaacgagcgcctccaacaaactgtacggtcatcgccccgataaaggcgaccagcaggctcaggctggcaaaccagaccaaaaaacggctctgatagcgggcatacagcatgtcattcagggtgacagcgttgtagcgacgggcgaggatggcaaattttttccccagcacgccgagggagagccatatcgcgggcaattggatcagcgacagcagaacccagccgataccgtacttataagctgcgccggggccgccaatgaaggaactggcgctgatgtaggttgccgtgatggtcatggccagtacaaaaccgcccattgagcgattgccgagaaaatactcattcaaaaattcgcctgtttggcggcggcggtaagcatagattgacagcaggaaaaccaacgccagatatcctaccagaggtaagatcacttcagtttgcattatcatcctccaatggaacttccttgaatataaacgccaccatcaaccaacagaggatgataaacagggctggcagtagcaggcaggccaattcgaaccagtatggcaatccggttaagcccgtggcatcactgggtaaataggcgctgactaaccaaccaacaagatacgccagcgtcaggaatactgcccagcgcgcttctttgtgggattgaacaaatcgtctgtccatccgttctccggataacttatataaaacaatgtggagggaattgtacggtaacctgcggatttattcaggggaaaatgtgccggaaaaattagcaaaccgtatcgttgagtctaattcgggctttatttgcatattaaaaataatcattttattgttgtattatgatggtgggttttctatattttttgtcttattggcgttgcgtttaatttgagtgatatagaaagttaaataaaattaaagtaataatatgttgtaataataaatcaaataattattttttcagttaaaaatattataattaacagtttgaaatatattagctatattcatttcttaaatcataaatggtttttctttccagtatgaaaacaaaaaatcccacctttaaaaagatgggattttaatcattcaaagcaacaacgtctgaacgtcagcaagaaaccttacttctcctgcaaacccagtttcttctccagatagtggatattggttccgcctttctggaaattctcatcattcatgatcgctacttgcaggtcgatattggttttgatgccatcaatgatcaactcagccagtgcgtttttcatgcgtgcaatggcaatttcacgggtttcgccgtacgtgatcagcttaccaatcatggagtcatagtaaggcggtacggtatatcctgcatagatatgggattcccagcgtacgccgaacccgcccggagagtggaaatgggtaatcttgcccgggcttggcaggaaggattttggatcttctgcattaatacggcattcgatcgcatgaccttcgatcacgatatcttcctgcttgatggacagtggcaggccggaggcaatgcgcaactgctctttaatcaggtcaacgccagtaatcatttctgtgacggggtgctcaacctgaatacgggtgttcatctcgataaagtagaactcaccattttcatacaggaattcaaacgtacctgccccgcgataaccgatttcgatacaggcattggcacagcgctcaccgatagtgcggcgcaattctgccgaaatacccggtgctggcgcttcctctaccactttctggtgacggcgctgcatggagcagtcacgttcagctaggtagagggcatgaccctgaccatctgccagtatctgaatttcaacatgacgtgggttttcaaggaatttttccatgtagaccatgtcgttgttgaaggcggctttcgcttctgcgcgggtcatggcgatggattgttccagatctttgtcgctgcgtacaacgcgcataccgcgaccaccaccgccacccgatgccttgatgatcaccggatagccgatgcgtttcgcaatggctttatttttctcggtatcatcccctaatgagccgtcagaaccgggaacacaggggacaccggctgttttcatcgcgttaatggcagagactttatcccccatcaggcggatggtttctgctttagggccgatgaaaataaaaccagaacgttctacttgttcagcaaaatcggcgttttcagacaggaagccataaccgggatggattgcctgagcacaggtaatttctgccgcagaaataatggcaggaatgttcagataactttttgctgatgccgcaggaccgatacagacggtttcatccgccagcaggacgtgtttcaggtcacgatctgccgtagagtgcaccgcaacggttttgatcccaagctctttacaggctctcaggatacgcagtgcaatttcaccacggttagcaatgacaattttctcaagcatggaacgcctcgttattcgatgacgaccagtggctcgtcaaattcaacaggttgaccgtcttgtgccagaatcgctctaaccacgccggttttgtcagcttcgatctggttcatcattttcatcgcttcaacgatgcacagggtatcgccctgattaacacgctggccaatttcgataaaagctttcgcatctgggcttggtgagcggtagaacgtgccaaccattggggagcagacggtatgaccgataatttccgctggtttttcagcagccgctggaatggctggtgcggcggtttgcacaggttgttgaacaggcgctgaaatatattgctgagtcattggcatgtgctgggctgctgctatacggctgatacgtactgactcttcaccttcagaaatttccagttcagaaataccggattcttcaaccagctcgatcagtttttttattttacgaatatccatgaatgtggttccgtactcttaggtaaatgagttgaatgttgacaagcggttgaccgctgcctgtaatgcgaagctataaccatctgcacccaatccgcagatcacgccaacggcaatatcagaaagatatgagtgatggcggaatggctcgcgggcatgcacattggagaggtgaatctcaataaatgggatatcgaccgctagaagtgcgtcgcgtagtgccacactggtatgcgtgaatgccgcagggttaatcaaaataaaatcggtattgccccgcgccgtatgaattctctcaatcaattcagattctgcattggattgcagatgagataatttgactcccgattggtgagcttcttttgacagtttgctgacgatgttatcaagcgttaacttgccgtaggtctctggctctcgcgttcccaacaggttcaggttggggccattcaagagtaaaatgcgaaacttgtctgccattgtgcgggtatctccggcaatctgtcaacaatcgaccaagataactcgatgttaacggtttgtcatctttttctgttatcattatttgtaagtttggcgatgaagcccgacattataaacatatcgtagcatttagcagctaaatactggtcttatcagctacctttaccaacgttctgccagtcatttggttgtttatcagtttattggcatattcgaccacttgatctaatgagatttcagtggtggcctgttgataaaaggcgtcaggtaacaatttttgtaatcttttccaaatatcagggcgttttatggcaggcacggtgactgatgcaatgccctgtaagcgaacattacgcagaataaatggcatcacagtcgtgggcagttggctgtcacttgccatgccacaagcggcgacagtgccgttgtaatgcacctgtgccaacagagttgccagtactgtgccaccgatggtatcaatgacgccggcccagcgctgtttttccagcgaacgcgatggctgattaaaatcagtggcaggcaggatcgtttttgcgcccagtgaaagtaaataatcttggttttcggttttgctgctgatggcgacgacggaatatcccagttgtgacagcagagtaatcgctgtgctaccgaccccgccactggcaccagtaacggcaatttctccactttccggtgtcactcccccctgctccagcgccatgatacataacatggcggtgaaaccggctgtgccgatgatcatggcttgtctggcgcttaacccctgcggcaatggtgtcagccattcaccggagactctggcctgttctgccagcccgccccagtgattttcacctactccccagcccgtcagcaaaacgtgttggccgatatgaaagcggggatcttcagaatgatggacaacaccagaaaaatcgactcccggcaccatcgggaattgacggataattttgcctttcccagtaatagcaagggcgtctttgtaattgagtgttgaccagtggacatccacaacgacatcgcctgagggcagttgcgaggtatcaatattttgaatagaggctgataatgtctcgtgttgctcaagtaataaggctttcatcattattctctcttgatgggttttttatatccgacaccatcaccattttgacatcaccacaatatagataaaattgagagtgctgaaacgggcgagcagcaatattgtgatggagagtggcaaaaccgcgattaattatttttgttcaagatgacagtgtaaaagatcaaatgcacagggtaacaataaggaaaataacattattgatctgttcagaataatccttatttttacctattaccgttgatggggacgctatttttgtcagtgcgctatccgggggaggtcaaaatgttgagaaaaaacacgttttggttgaacttgcagaagtgattacaggtcaacatagaagcagtaaaatcagggtagtggtatcgcgatatgcactataatgttggtttttgagacatttgatcattttagggcatggtgatgaggttatcggtgaaattaacccgtttttatgcagtttttttctgctccgttagagaaaagtaacgtagaatattgtgtgtctgatatgaataataacgtagccacttttattgaagtagtaaaagtagttagtgatgcgccttgtcgctgcttcatgtggttggtagagtagacggacaatatccgtccccagcttgcaggattatcctttcgttatgttaaagaaatttcgtggcatgttttccaacgatttgtccattgacttgggtactgccaatacccttatttacgtcaaaggccagggaattgtactcgatgaaccttctgtcgttgctatccgtcaggacagagccggttcaccaaaaagtgttgccgctgtagggtcggcagcaaaacagatgctggggcgtactccgggtaatatcgcagccatccgtccgatgaaggatggggttattgccgatttttatgtcacggaaaaaatgttgcagcattttatcaaacaggttcacaacaacagtttcatgcgcccaagcccacgcgtactggtctgcgtacctgttggggcaactcaggttgaacgtcgtgctattcgtgaatctgcccagagcgcgggtgcacgggaagtctttttgattgaagagccaatggcagcggcaatcggtgccggtctgcctgtttctgaagcaactggctcaatggttgtggacattgggggtggtacgactgaagttgcagttatttccctcaatggcgttgtttattcctcttctgtccgtatcggcggggatcgctttgatgaagcgattatcaattatgttcgccgcaattatggctccctgattggagaagcaacagcagaacgtatcaaacatggaattggttctgcttatccaacggatgaagtccatgaaatcgaagtacgtggccgtaaccttgccgaaggcgtaccgcgtggcttcaccctgaattccaatgaaatccttgaagccttgcaggaaccattgaccggtatcgtcagcgcagttatggtcgcactggaacagtgcccgccagaactggcttctgatatttcggaacgcggtatggttctgacgggtggtggtgcgctgctgcgtaatcttgatcgcctgctgatggaagaaacaggcattcctgtcattgtagctgaagatcctctgacttgtgttgcccggggtggcggcaaggcgttggaaatgatcgacatgcatggtggcgatctgttcagcgaagactgaacgtaactctgcgagctggggggcgattatgtgttatcagagcctccttgctgtttgttcgggagtttgatcgtttatgacacaacacagcttaacaatgcgcaatttatgaagccgattttcagcagtggatcttctctgcaattacgactctttttagctgttattattgccattattctggttgtggtagacagccgtttcggtttttttaataaagtccgtagctatatggatacggcagtcagtcctttttattttctggccaatgggccacgccaatttctggatggcatctctgaatctctggctacccgtaagcaccttgagatggagaataataccctacgcaatgagctgcggttacagaacagcaaacttctcttgctggggcaactgaaacatgaaaactcccgtctgcgtgaattactgggatcacccgtgcgtcgtgatgaacacatgatggtatcgcaggtgatttcgggtggcatggatccttatcgagatcagatagtcattgatagaggagctaaagatggcgtgtatgaagggcaggctgtcatcagtgatcggggggttgctggtcaagtcatttcagtgagtcatttgagcagtcgggtattgttgatttgtgatccgactcatgggttgcccgttcaggtcatgcgcaatgatctccgtgtgattgctgctggagcggggtgtacggaagatctgcatctagagccgatggcaagcgataccgacattcgtgttggtgatgtgctggtgacatcgggtctgggcgggcgttttcccgaagggtatccggtcgcggtggtgtcttccgtcaaaatagacaaccagcgggctcatgtggtcattcgtgcacgtccattggctgaattacgacgcctgcgctatctgctgttgttgtggggatcaggtaacgatccgtcggaaccgttgccaccttccgcagtacatcgcgcagcaaatgaacgcttgatgcagatgttacctgaggtactgccaaatccacttgaagaaaaaccgcagcttccgacgcaggattcaggtgaaggaaaagaaggcaataaagaggggaataaagtaccgtctgtaacaaagccctcatcttcagctacaggaaatcgtcaatgaatcaatatcgtagtcgagggcgctgggttatctggttatctttcctgattgcaatcgtgttgcagattatgccgtggccggagcagttctatatgttccggcctaccttactggtgctgtgcttaatttactggctgcttgcgatccctcatcgcgtcagtgtgggtacgggctttgtattaggcatcattactgacttattacaaggcagtgttctcggtgcgcatgctttggctttcagcatcattagtttcctggtggtgttcaagtttcagttaattcgtaatatggcgctctggcagcaagcactggttgtcgtggcgctttcaacgctgatgaatctctgtgtttttctggctcatgctttgataccaaagacgcttttccatccagaagtgttctggaatggcctggtcaatggtattctctggccttggctattcttattaatgcggaaaatccgtcgtcaattttcagttcgttaaaggcagtttcctgttttttaatggactgatattaatagcctccaatgcaatatgctttaaggatgactcacgatgaaaaccctttacttagcttctggctcaccaaggcggcgtgagttggtgggaatgttagacttcaattttgagattctgacaccacaggttgaagaaaaatggcaagaaggggaatcaccgcagcaatatgtcagccgactggccagagaaaaagcacaggctggcgtggcaatagcaccgaatgactttcccgttctgggtgcggatactattgttgtattgaataaccgtattctggaaaaaccgcgtaatccacaacatgctgctgaaatattgagggctttgtctgggcagagccatcaagttatgacggctgtagctttatcgaacagtcagcacaccctaagtgagatagtcattacagatgtgatattccgccagttatcccaacaggaaatacaggaatatattgtaactggggagccgatggataaagccggcgcttatggcattcaaggtaagggcggttgttttgtcagaaaaattaatggcagttaccatgctgttgtcggcttaccactggtggaaacatatgaattaatcacacgatttttggcattagctgatgggaagcattattcatgacagcagagttattagtcaatatcacgccatccgaaacgcgggttgcttatattgatggcggtattttgcaggaaatacatgttgagcgagaagcgagaagaggcattgccggaaatatttacaaaggtcgggtgagccgggttctgcccggaatgcaggcggcttttgttgatatcgggctggagaaagccgcctttcttcatgcttcggatattgtgcctcacaccgaatgtattgcgggtgaagagaagaagaatttccatgtcagagatatagccgagttggttcatcaggggcaggatttgatcgtgcaggtggtgaaagatcccctcggcacaaaaggtgcccgattgacgacagatattaccctgccatcccgttatctggtgtttatgccgggagcctctcatgttggtgtttcacagcggatagagagtgaagaagaacgcgaccgcctgaaatctattgtgatggattactgtaatgagcatggagggtttattatccgcacggccgccgaaggtataggggcagaagagctcgtacaggatgccgcatttttgcagcgcctgtggggtaaagtgattgaacgtaagaaacgtaatatcaccaaaaataaaatctacggtgagctggcactggcacagcgtgttctgcgtgattttgcgggcgctccccttaatcgtattcgggtggattcccgtcagacattccttcaattacaggaattcatcgacgaatatattcctgaaatgaacgccaagctggagcattatcagggaaaccagcctatattcgatctttatgatgttgaaaatgaaattcagcgcgcgctggaacgtaaagtagaattaaagtcgggtggttatctgattattgatcaaacggaagccatgacgacaatagatattaatactggcgcttttgtcgggcatcgtaatctggaagaaacgatctttaataccaatattgaagccactcagtcgattgcccgccaactaaggctgcgtaatttaggtgggatcattattattgattttatcgatatgggtaatgaagaacaccgtcgccgtgtgctggcttctttagaacaggcattgagcaaagaccgggtgaaaacaaccattaatggcttttcccagcttggtctggtggaaatgacccgcaagcggacacgggaaagtatcgagcatattttatgtgataactgtccgacttgtcagggacgtggcacggtaaaatccgttgaaacagtatgttatgaaattctgcgtgagattgtgcgtgttcaccgcctcattgatgcagatcgttttctggtttatgcctctcctgctgtgagcgaagtcctgaaaggggatgaatctcacgccttggctgaggtggaaatttttgtgggcaaacaggttaaggtacagacagaacaactctacagtcaggagcaatttgacgttgtgatgatgtaaaaccaccggtttgcagagagataacgctgacaaccaaggagaaatgtgtgaggcgactgccggggatattattagcgacagccgcaatagtcgttatcattgtggctttgcttgtcagcgggttacgttttttcctgccacatatcaatgattatcgtcagcaagtggcggaaaaaattgctgctgtgacggatatacctgtccatatgggttatatcaacggccattgggaatcatttggccccagtttggaaatccgtgatatcagcgccaaaacaaaggatgcgagttttcaggctaaaaaggtgacgctttccctgaatgtctggcgttcgcttttacaatggcgctggcatttccgtgacctgtctttttatcaactggaagtcaattatgataagcccctgtttagtgggaaagatgaaaatctactttctgagccagacagcctctcttcctttgttcttgagcaacttaatcattttgatttgcacgacagccgtttgaccttccagacaccatcgggtgaaaaagcgcaactgatactgccacaactgacatggctgaataaagacgatcgccatcgagcacagggaagcgtcaatctctcttcgattaatggtcaggaaggcgttgttcaggtgaaatttgacctgaaagatatcaatggggttctggataatggtgttatttatttacaggctgatgatattgatatgcggttgtggttaagccgttggttaagagataacacggggctggaaagtagccgtttcagtctggcgagctggattaccctgaaagggggaagaattgacagcgggcgtctgcaactgaagcaaggagaagccaactggtatgttggtagtgaaaaacaccagcttgcggtcagtgacctcattctgcaaatgtgccgacagggtgaaggctggctgtttaatatcccgaatctggcaaatctgaaaaccaatggtcagcagtggccagtgggacgcattgcggcgctgtatgtcatgcaggcggacaaataccaaggaaaagatcactggcgtctccgtgctgaaaatattcaacttgaacgtctgaatggaatattgccattactctcttctgtgacaccgaatgttgtcaaagattggcagcatcggcagccgaaggggatgctcaaccactttgcccttgatatcacgcctgaattaccggatagctcaatgggaattgccatcaaatggcaggatgttagctggttacgctggcaggatctgccgtctgtcaaccatttcagtggaacgttgagtggcaataagcagtggggaagtctgaaatttgagctgaaaaacagtaccgttgattatcgcagcttgtttcaggcgccgttcgacattacgagcagtgaagggcagtttgcctggagaaatgaccatcatgggttgaaggtgtgggggcgggatctggatttacaggccaaatcattatggttcaatggggcttttaactatttgttacccaagaatgagccgccagtgctggaaatgcttgcgggaattcgtgttgatgatgcgggagaggcatggcgttattttcccaagccactgatgggggcatcattgacggactatttgacccactctctgattaaaggaaagatcgagaatgccactctgctctttcaaggcaatccccacgatttcccgttcaagcagaacaatggccaatttcaggtttgggttcctttgcgccatgcgacctttcaatatcaacctgactggcctgccttgtttgattttgatatcgatctgaatttccaaaataacggattgtggatgcaggtaccgaaagcgaagttggggaaagtcgatgccacccggctgactgccgtgatccccgattatggcaaacagaagctattgattgacggcgaattatcggggaatggcaaaaatatccacgattattttaaacacagcccattggcagggtctatcggcagtgcgctggatgagttacaacttgatggcagagttgatggtaagctccatctggatattcccttggaggatggcaaagtcaatgcgagtggagaggtggtattgcaagataccgcactgttcatcaagccattggatagcaaaatggaacatgtgagtgggaaatttcgctttgatgatggcaaactgcaaagtgatacattatccgctcagtggttgggacatcctctgtccctgcggtttaccacgcaggatttaccgaagcattatcaggtggatgttgatctgaatgcgcactgggctgccgggaaattaccggaagtccccgctgaaattcgccgccaactatcaggaacgttggattggcaggggaaagtgaacatcgctatacctgcacaaagcacatcttcacacactaaaccgcaacaaaatggtgtgaaataccgtgtttcgatcaatgcagatttgtcacatatcaacagtaaactggctgcattggacaccgaattgctacgggaatggcagggtatcgatgttcttgctgagggggacatgaaccaaatacagattaaaggttcactgggaaaacaatatgcattcaatacccaatggcaattgggaaaaacacatgcccgactacaacgcggtattatgaatagcgagggtaatggcactccaatactgccggagaagtcgctgctggcgttaaacctgcctgagattgatggcgaaaagtggttgccgctgatagcgccactgatgtctggttcatcagaagatgatggcctgttatggccggaaatgttcgaaatttacatgccgtcactgaagattggcggccagcgctggaatcagctcgtcttcaatattgttcaacaggccgatggcatgaaggtcagcgcggtgggagaaaagctcaaaggcaatctgttgatttaccgtcatgagccgtggcaagcctcaatcgattacctttattatgatccgcagtttcctgaagattcatcggctggctccgatacgttaacttcagacaccacggaagccaaaaaatacggcttgcgccattggccgtcactgaatgttaagtgtgcagagtgctgggttgccgggctgaaactcggcaaagtatccggaacggtgatgccggaaggtgattcactggttttgacaaatggacaactggagaaccgtgcgggcaaattgacattatctgggcgctggggtgaaaacgatattggaaactatactcaggccaaagggcaattatcgggacaaagattcgatgagatggcggcttatctggggtttatcgtcccaatagtcgatgcgccgtttaaatttgatttcgatctgggttggcgggggactccgtggaaccccgatattaaaacgttgaatggtacactgacgggcgagacgaaaaaaggtgctatagccaaattgggtggtggtcgggcggggcaattgttaagactgatcagttttgatgcattgctgcgtaaattacaattggatttcagtgacacattcagtaatgatttcaacttcgattccatgcgtggcgacacaacgatcaaaaatggcgtcatgtataccgaaaacttccgtattgatgggctggcggcggacatcgatgcggaaggtcagacagacttggttcgtcgacagatcaatatggagttggtgattacaccggaaatctcgacaacggttggtgtggcgacagcttttgcggtcaatcctgtggcaggtgctgctgtttttgcggcgacaaaagtgttggggcctctgtggagcaaaatatcggtcattcgttaccggctcacgggtagcctcgaacagcctaaaattgatgaagttttacgtcagcttaaggagaataaagggtcatgaaaaacgtcaatgttgcacttttacaattatgcagtggtgcgaacgtcaaacataatttagcgcaagttgaacagcagattaaacaactgccggatacggtaaaattagttctgaccccggaaaatgcgttactgtttgcagacgctgatacctatcgcaagtatgcagaagaacagggaagtggcccgttgcagcaggctgtgagtgaaatagcacagcgttatggtgtctggttgctgattggttcaatgccgatgatcagtcgggaagagccgacccgcatcacaagcagtagcctgttgtttgatgatcaaggtgaaatccgtgcgcgctatgacaaaatccacatgtttgatgtcaatatcaacgatgaacatggtgcctacaatgaatccaccgtttatcagcgtggggagcacattaccgttgtcgatacgcctgttggccgtttggggatggctatctgctatgatctgcgttttcccggactgtttcaggcactgcgtgaacagggggcggaattgatatctgttcctgctgctttcacccgcctgacaggtaaggcacactgggaacctctcctgagagcacgggcaatcgagaaccagtgcatcattctggcacccgcacaggttggggtgcatggtactcgcagaacatgggggcattcaatggcggtgagtggctggggggaagttatcaagaaaaatcctctgaccgtcagtgcattacagctcaacatccggcgggatagtctgactcacatgcgtgagcagattaaagtcgtgaaacataatcgattccgtccacaactgacttctttgataaaaaagaatacaaattaaggtaaaagagtaatcactatgagtttaacttttgtcagtgactatttactggctgctaataacctgaatcatcaagatttattttctgtattgggacaattggcagagcgccgtctggattacgccgatctctactttcaatctagctaccacgaagcatggattttggaagaccgcattattaaggatggctcctataatatcgatcaaggtgtgggcgttcgggcgatcagtggagaaaaaaccggctttgcctatgcggatcaaatcacgctgaatgccttgcagcaaagtgctcaggcagcacgcagcatcgtacgggaagcgggtaatggcaccgtgcatacattgggtgcggtcacacataaaggactgtacccagcgatagaccccttgcagagtatgagccgggaagaaaaaattgccttgctgcaccgggttgatcagattgcgcgagctgaagatccccgggtacaggaagtgaatgccagcctgacaggggtttatgaacagatgctggtcgcggcaactgatggcacattggccgcagatattcgcccattggtacgtctctctgtcagcgtactggtcgaagaagatggcaagcgtgaacatggttccagcggagggggcgcgcgttatggctacgaatacttcctgcaaacggctgacggacaggttctggcagaacagtttgtccgtgaagcggtacgtatggcactggtcaacctttctgctgttgcggctcctgcgggcacaatgcccgtcgtactgggcgctggctggccgggtgttttactgcatgaagctgtgggacacggtttggaaggcgattttaaccgccgtggtacttcggtcttctccggccagatcgggcagcaagttgcctctgaactgtgtaccgtggtcgatgatggcacgatcgaagggcgtcgtggttcattatctgttgatgatgaaggtgtaccggggcagtacaatgtgctgattgagaacggcattctgaaaggttacatgcaggacaagcttaatgcgcgcttgatgggtgtggctccgaccggtaacggtcgccgtgaatcctatgcacacctgccgatgccgcgaatgaccaacacttatatgttggcggggaaatccacaccggaagaaattatcgccagtgttgatcgtggtctgtacgcaccgaatttcggtggtggccaggtggatatcacttccggaaaatttgtcttctcgacatcggaagcttatttgattgaaaacggcaaaattaccaaaccggtgaaaggtgccacactgattggttcgggcattgaagctatgcagcaaatatcgatggttgggaatgatctggctcttgataagggtgtcggagtgtgtggtaaagaaggacagagtgtaccagtgggtgtcgggcagccaacattgaaactggataatctgaccgtggggggaaccgcttgataatttcttgagtggtataataataaactaaacgtgaggtcattatgaaaaagagcatactagcaggtatcttattgattttggcttttgtatctatcacttttgcccaaggctctgagtcggttggcgcagaaaaatcacagcaaaatacagaggtattggagagcgcctcttctgaaccgattggcgttctgactaaaccgaaacgtgttgcgcagtatcttcgccaacataacaatagtagacttcccgattattacctcacgaaggcacaggcgcgtaatcttggttgggatgcccgtaaaggcaacttatgccaagtctcgccgaatacggcgatcggtggagatcggttttccaatcgtgaaaataagctaccgaaaaaacgtgatcgccagtggtttgaagcggatgtgaattatagctgtggacaccgaggcagtgatagattgctctattctaatgatggcctgatctatctgacagtggatcattacaacacgtttaaaaaattggagtgatgatatgaaaaaagtggaatttgattttgaccgtatccctgacttagaaaccttctattgcgaatttaaggagagtttcgatattggtgatcattttggtgcaaacttggatgccctgtgggatgcggtaacgggtggcattgagttgccggttgagattagttttatccacttttcgtcgcagaaacgagtatattttgcggctttagttttgctgtttgaagaagccgaagaagaattggaaggggaattgcagtttaacatagtagagtgagttttcctttcttgttcgtgaatttgggctttctgttatatgaccgtgagcacctgaggtattcatcaggtgctctgttctacttcttattgagcaaagaaaatcgtataacctattttcatgatgtatatttaaaaccatttgatattaaataatttttacccacgcctttttttctatatttattttttataaataatcttttattttaaaaataaatatcattaaatatattttatatttttgcgtttatttatgctttattagttttatatttatttagacttaaactgttaacgtaagttaatttaatgtaactaactatgaatatagatgcttggtttgtgacctcatagaggtgatgaagataaaatggcggagaagaaagagaataccgccagttcttaaagaattggcggtgggaacatattaagctgattcagacagctctttcagatattggaaaatctgacggtaggattttggtggcttgttggtctctttctcttttttggcgttgcgaaccagcgtcctcagttgctggcgatccacatgcggatacaacgtaaccacttccgtcaaggcaccatctgcatcttcaagcagtttgtcacgtaattcttccagcttgtgaaacagcactatctgctggttgtgacggttattcagtttatccagtgcaatggtaatcggttccggatcgcgggaacgcaacattttgccaattaactgcaactggcggcgacggccttcacgcttgattctctgtgccagctcaatggctgccagcaggtcgtcatccagcggaatgcgttccagtgcgtttttactcagttcaaccagctccattcccagctttttcagtgcttcagaatcccgcttaatttcacttttactgacccagattatctcttcgtcttcctcttctgcaggataattgtcaagccaatcttcaggctgctttaccataatcgttttccttctaaaaaggccggataaggtgcattttggaacatgaccaatcgtccggtgggtgttaacatcctaatattgtgtattgtaactgggaaaattgcctgattaccactcggcattgacgttgtggacgaatgtgaggcgctttttctgataaattatctctttaattcattggattacggttaattaatgatagtcactaatcaatatatcgcggaacagcgcaagcaattggaagatgcggtctcccacgctctcgaattagcgaagaccggttctgatgctgcggaagtctcggtcaataaaacgacggggattagcgtcagcacccgtttcagtgaagtcgaaaatgttgagtttaacagcgatggtgcgctggggatcacggtttatcaccagcagcgcaaaggcagcgcttcttcaaccgatctcagcccagaggcaatagcccgcaccgtgcaggccgcgattgatatcgcccgctatacgtcacctgatccttatgctggcccggcggataaagatctactggcattcgcagcgccggatctggatctcttccacccggctgatttagatacggataccgccattgaactggctgcccgtgctgaacaagcctcattgcaggcagatcaacgtatcaccaataccgaaggcggcagttttaacagccattatggtatccggatatttggcaatagtcacggtatgctgcaaagctactgctcaagccgccactctctgtctagctgtgtgattgctgaacaagatggcaatatggaacgtgattatgcttataccgtcagccgccgttttgacgaattgcaatcaccggaatgggttgggcaggagtgtgctcgccgtactctttctcgtctgggtgcacgtaagttaccgaccatgaaagcgcctgttatcttctctgcggaagtggctacgggactgttcggtcatttggtcggggcgatcagtggcagcagcatttaccgcaaatcttctttcctgctggatagcttgggcaagcagattttaccttcgtggctgacgattgaagagcagccgcatttactcagaggtctggcttcaacaccttttgacagtgaaggtgtgcgtactgcaccgcgtgatattatcaaagagggtgtgttgcagacgtggctgctgacttcctattcagcccgtaaactgggcatggtgaatacggggcatgcaggtggtattcataactggcgtattgcgggtcaagggctggattttgcagctttgttgcgtgaaatgggaactggcctgattgttactgatctgatggggcaaggtgttagtgcggttaccggcgattattcccgtggtgcatccggtttctgggttgaaaatggcgaaatccagtatccagtcagtgaaatcaccatcgcaggtaatttgaaagatatgtgggcgaatatggtgaccgtcggtgatgatatcgaaacacgcagtaatattcagtgtggttcggtactgctgccggaaatgagtatcgccggtcaatagggatactcaatcaacaacagccagtttgggttttactggactggctgtgagttagcgatgatattcacctgcggcttcgggttgataaataatttctaatactttgatccgggttttttcactgtttggtagttgccaggttatctcatcattcaccctcagacccaaaagagcagcgcctaaaggtgccatgacagacaggtgcttggtactatcctgtagagacgctggatacacaagagtgcgtacacgctcttcgttgctgcccaaatcaataaagcgaatttcactgttcattgtgacaacatccggcggaatttcgaccggaggcacaatttcagctcgatccaactccgcattcagcgcctctgcaatgctggtattggcaaaggccggttgttccaacagcgaatctaaacgttccgcatcaagttcgttaataataatttttggttttttcataccacgctccaaattaggctcaatacaaaataacaccccgcatcacaaggaggggggtgttattttcaaagtaataaaattgatattaggctgttctgacgtgaaaataaagagatcatgatcacgaactgttttgtgctgttaatggaatagggttaacccacacagaatggaagaacagcccgatatcattttgagccgtggattatgcgcctgtaatggcgatccttgggttggtttctccccagatggaagagaactcaacaatatgcattccgccccatttttgaatgtcagattgggtaatttcttctttgccttgtttaccgaagatgaccacttcatcgccactcttcacatcaggcaaatcagttacatcgaccatgacggtgttcatggaaacgaggccgacaaccggtgcgcggtgaccgttgatcagaacaaacgctttgttggacaggctggagctgaaaccgtcagagaaacccacaggcaggttagccagtttggaatcacgtttcaggatgtaggtgttgtcgtagctgacaccattacctttaggatagggtttaacagaagcaacgcgggtttttacctgaatcagtggcttgaattctggatattcaggggtcagaacgccgtacagtgcactgccgactcgcaccatgtcgaattgtgcttcaggtacgctgattgacgcataagagctcgaagcatgcagagtgatctcgtttcttttcagattggcggttttgatcaaccaagccgtttgttctttgaaatcattcacgccttcgcggatcgcatccagatcttttagggcataatggctcatcatgccaaccagttttaggttaggtaactgggcgattttcagcgcttcttgtttaccctgctcagttttcatttccaggccgttacggctcatgcgccccgtgttcagaactaaatggacacggattgctttgccgtgttttttggcaagggcatcgatagttttagcatgttctagatcgccaaccatttcttccatgtcatagcccagcgtactttcaatttcagtcgcagccgccgcacggatacgcatcaattgccctttgaagccgctttcacgcacgatgcgagcttcttcattgctggtaattcctacacaaggtatgcctgttttgatgacagatggcattagtaaatcgataccatgaccgtaggcatcacctttcagaactacacacactttggtgtctttcgtcagtttgctttgcagtgtgtggatattattttcgaaagtcgtcgtgttgatttcaacccaagcgttgttagtagctgcaacgtgttctgcctgaatattgtctaaagaaagtgcaggggcggcttgagcagtgccttggcatagggttaggccaagaaggattgccagtgtaattttattaaaacgcatgaagtaatctccggtttaatatttgaactgtaaaaatgctccgagtgttaataccccgtaatgataagttttttattaattaatttcatatagttaagctttatggggggtaactttgattgtaataggaatactatttgtaaataagcaatattataagctaaatttatattttaagatgttaatgatcttctgggagtaatgtctggcagaggaaataatgagaggaatatggcgtgattctgggttgattttcacccttggtatccattgttgaatactgataattgtttatttattcgacagcggtattatttgaacgatatatagtcgtcaatggcaggaactgcgaaaaaacgatatttcgcttaagaaacggcattttatagtgagatgattcagtgtttaaaaggaaggaaagggtagggaagagtaggaaagtgtttattcttcatcaaatccggcattaaataactcaataatggcggccagtgcctgctgctcatccgaccctgtcgcctcaacttcaatgtaactgccttgttcggaatccagcataagcatggcaatcacactgtgggcttcggcttgaatattgctgctgttgcgcagaatgacctgcgattgaaactgttgcacaaggtcatgcagtttcattgcaggtcgggcgtgcataccaagccgatttttaatttcaagctgctttttgactgtcatgctctgccattattgtattatttacgtttttccagtgtgcggtgacgtgattgcacgtttttgccacgggaacggaagtagtccgctaattgttcagcgacgtagacggaacggtgtttaccccccgtacaaccaattgccacggtgagatagctgcggttattggtttcgagcatcggcagccagagttcaagatagctgcgggtctggtaaataaaattgtgtacttctgtgtggcgatccaaaaaggcagctacaggacgatctaaaccggtcattggccgcagtttagggtcccagtgtgggtttggcaggaaacgcacatcgaaaacataatcggcatcaatcggaatgccatgcttaaagccgaaagactcaaacaccatcgtcagttcgcgttcgcgtttgcccagtaaacgcgttctgagcatttctgccaattcatgcacggacatttcagaggtgtcgatgatcaagtctgcccgtgaacgcaggggttccagcaggtcactttcttgatcaatagcgctttccagcgacagatttttgtttgatagtggatgcaggcgacgtgtgtcactgtagcggcggatcagggtgttgcgatccgcatcaagaaacagtaattgtggcgagaacgtgtccggcagtttcgtcagagcttcttcgaaaatttctggcgattccggcatatttctcacgtctatgctgaccgccgctgaaatagagcgttcagccagtgtgcccgccagttccggcagtaagaccactggcaggttatcgacacaatagaaccccatatcttccagcgcacgcagggcaacggatttaccggagccggaacgaccgctgactatcatcagcaccatgagatgactcccctttaatatctcagcggttctaatgagccgctagctgttttgttgcttcccaataattttaatcgctatttattcagttatgattttatatagctcttcgtcactttgtgctgaacgcaggcggcggcagagattcttatctgcaagacgctttgcaatcaatgatagtgaatgtaaatgggtctgacactggtcagacggcaccaataaagcaaatagcaagtcaacaggctgattatcgatggcatcgaaggcaataggctgttccagattcagaaacacgccaacggcattatgtgagcactctttatccagtttgccgtgaggaatggcaatcccgttgccgatacctgtggtgcccactttttcgcgggaaagaatggcctcgaatacggtattttccggtaatccaagctgttttgatgccagttcactgataatctctaaggcgcgctttttactcgaacaaggtacgttgttgcgtgtacattcgggcgaaagcaccgagcttagtggtaaatctgtttcgttgttcatttctttattcacttagggcctgtaataccggatgcctgactggaggcacccggtattgatgcactgtttatacctttcatctgaaatctattgggtatgtaagtagaacagtgatgagtttatgacagccccgttgccagaaagctgttaatgttgtctcaatttacttttgtgtttggtcaattgacgtgccagcttatctgccagcgcatcaattgccgcatacatgtcttcatgctctgagcttgcatgcaactcacctccattgacatacaccgtggcttcagcgattttctgcactttttccactcggagtatgacctgaatgaggttaattttatcgaaatattgatccagtttgccgcattttgtattcacaatgttgcgtaatgcatcggtgatttcaatattgtggcctgtgacattgagttgcatagtgttttccttctctgtgttgttcaaaccagttttttgcgttggtttgaaggcgggatggataacgactctctatattttgcgacagttcgacgcgctacttgaatgccctgttcggccagtatgctggtcaatttgctgtcactcagtggcttggccgggttttctgccgcgaccaattttttcaccagtgcccgtatcgcagtagaagaggcttcacctccgctatcggtattgacatggctggagaaaaaatatttcaattcaaaaatgccccgtgggctatacagatatttctgtgttgtcacacgggaaatggtggattcgtgcatttcaacctgataggcgatatctgccagtactagcggtttcatgtgctctgcaccatattcaaaaaaatcttgttgccgttcaacaatgcaactggcaactttcaataacgtgtcattacggctttcgaggctttttatcagccacttggcctcttgcagattattgcgaatgaacagactgtcgctttcactatgggactgttgccccaacgctgcgtagtgttgattgatgcgcagacgggggatgctatcggtattcagtttgacttgccagctttcattttctttatgagcaagcacatcaggaataacatactcggattcacctgtattgaccactaatccgggtttgggttccaatgattgaataatatcgatggcttctttcagggcgttttcctttaatttgctctgacgtaacaaattacgaaagtctcgattgcccaatagttcaaggtatttgctgacaaccagtttggcttcgttcaggtaaggtgtttctgttgacagcatcgaaagttgaataagcaggcattcacgcaaatcgcgggcggcgataccaatcggatcgaaatgctgtatgcgtttgagtacgatttccacttcttccagcatcagctcatcatcgccaatgctggcaaggatctcttcgattgaaactgtcagatagcctgaatcatcaatcgcatcaatgatggaggtggcgatggcagaatccgtttcagtaaacggcgtcaaccctgcctgccacatcagatagtcttgcagtgtctgagtggtttcaccctgatagacgggaaaatcctcagcactgtaatcgctgtttgtccccgaagaagtgccagccgtgtaaatttcatcccaactggcatccaatggcagttcttccggtatatccttctgttcaagcgcttcgcgggtatccatcacctcagttgccgcatcaggggattcctgactgtcaatttcctcatgcggatcatcctgttcaagcagtgggttagcttccaaagcctgctggatctcttgttgaagctcaagcgtagaaagttgcaacaaacggatagcttgctggagttgtggcgtcatcgccagttgctgactgagcctgagttgcaaactttgcttcatagcattaccactttctcctgaatttctctggaatttctcctgaatgacgcctgacagaatcaggattaaagacgaaaaccctcacccagataaacgcgtttgacttgctcgttgttgagaatatcttccggggagccgtgggcaatcaactgcccttggctgacgatataggcgcgttcgcagacatccagtgtttcacggacattgtggtctgtaatcagaactcccagcccatagtcccgcagatgttgaatgatctttttgatatcgagtacggagatgggatcgacgccagcaaaaggttcatccagaagaatgaatttcgggttggcggccagagcacgggcaatttccacacgacggcgttcaccaccggaaagtgactgtcccagattgtcacgcagatgagcgatgtgaaactcttccatcaattcttctgcccgttcttttcgttgttcttgtgtaatatccttgcggatttccaagactgccatcaaattgtcaaatacgctcagacgacggaaaatggaaggttcctgcggtaaatagcctatccctcggcgggcgcgttcatgcagcggtagcaggctgatgtcttcaccatcgatggtgatggtgccagtatcacgtggcacaatgccgaccaccatgtagaaggtcgtggttttacctgcgccattggggccaagcaaacccacgatttcgcctgatttgacggtcagactgacgtcctcaacgaccctgcgacccttataagcctttgccagattttctgcgtttaaaattgccatacgtcgttatttactcttgttgttaacactggtgcctttttcctgtagctgagaaggcaacaggacggtagtaacgcgtttacctttgtcactaaaggcttccatttgctgtgttggcactagataggtgattttatcgcctttgatgttactgtcgagttgttcaagataggcattacctgtcagcgtcatcagctctttatccatctcatagcgcatttttgaggcatgccctttgatgggtttgccgtcatcttgtaactgatagaaagtcgccggattaccgtaggcttcaataaccgtttttttcgcatccccttctgggcgagtgacgacgactttatccgcatgaatgtcgattgagccttgttttacgctgacattatccgtaaatgtggctacgttccccgttaaatccaaagattgcctgtcagaattaagggtaatgggctgtttcgtatcttctttcaatgccagtacgggcaggctgactgcaaacagggtactggcaataacggtattacggattaggttgttcatttgggatctcatagtgagtcgtcaccttttcaatcaattcagcagttttgtttcgcagattgccacgcattttcatgccaacagatttcaggccgacaccaatcagagtgacttggtcgtcggataagatatcttgagacaccagattgacggtcgcattttctgtcgtgatccgttgcagttgtgatgcatcggtcaggctatccagctggacatcgccgtacagatagagcattttatcgttggtcagctttgctttatttgcgcgtactgtccatgtcggtgtttcggaagtgctattgggggcaaaggttgtcaatatgggtttagtaaaccaagtcagtttggtttccgtatagttctgtacgtcatctgccaccagtttgtaagccagcttgccctcgggatcatagacaaaagaagtggcttcctgtgtttgataagtgggatgtccatcatccacaatcggcgatgaagcgttttcatttaaattggataaattccagccaatcagcgcaagcgcgatcaatgccagtgttccgatcagccaggattgaattctgctcattctcttttcaattttagtcttatattgataaccctttggcatcttccagcttattctgagcgaaaagtaccaaatcacaaagctccctgactgcaccacggccacctgcaatccgagtcacataatccgcccttggcagcagcagtggatgggcatcagaaaccgcagccgataacccaacttgtgccatcacaggccagtcgataagatcatcaccaatataagcgacctgttctggctgtaacgttagtttatctaacagttccttatacgccaaaaccttatcgctctgtccttggtaaagatgtgtaatacccagtgtttctgcgcgatcttccagcaacttagcgttacggccagtaatgatggcgacttcaatgcctgaggtaatcagacaacggatgccgtaaccatcacgaacgttaaaggctttcagttcttcaccctgattgcccatatatatcaggccatctgacatcacaccatcaacatcacaaatcagtagacggattttactggctttttcgataatttcttcgttgaccgggccataacaggtgtccagatacgttttttgactcattcaggaattctcttaaggtttataccacagctgcttataccattgcctgtgctttatacatactctaacccttcatctttctctgttgggtatataccgaccttatactacacccgcctgcaagaggtcatgcatatgcagtacgccgagcaatttttcaccgtcagtgaccagcagggaagtgatgtggcgtgactgcatcaggttcagggcatcaacggccagtgtatggggcttgatgcggacaccgccggcagtcataacatcagagatgtttgcatggtttaaatcggttcccatatcgaaaacacggcgcaaatccccgtcagtgaaaatccctttgatctgcatatcgtcatcgcagatgacggtcattcccagtttcttacgggtgatttcaaccaaggcctcacgtagtgtcgcggtataaggaacacggggaatatcatcgccggtggtcattaaatcactggtcagtaacagaagtttgcgtcccagtgtgccgcccggatgggaaagggcaaaatcttcagcggtaaaaccacgggcctgtaagagcgcaacggccagagcatcccccatgacaagtgtcgccgtcgtgctggtggtgggcgccagcccaagcgggcaggcttcctgtggcgttttgatgcacagatggatatcggcagctttccccatgctactgtttgggttgtttgtcatacagataagcggaactttttgccgtttgaggacggggatcaaagcaaggatttcattggattcaccggagttggagattgtcagcacgatgtcttttgatgtcaccataccgagatcgccgtggctggcttcaccggggtggacaaagaaagagggagtacccgtactggcaaatgtggcggcaatttttcgtccaatatgaccggatttgcccatccccatgacaatgacttttccttcacaactaaacatcaactcacaggcccggctgaaatcttcattaatatattgttccagttctgccaatccgtcgagttcgacctgtaatacttttttacctgcttgttgaaaatcgatcttagacatttttacttcccacgtcatcggcaattaatcagtaccgtaataattagaaacaaaaagtacgacaaaataagcgataaaacagcccagtaacaggacgccgtttaatcggttcaatcgatgctttttccccagacagaatatcgtgaataacacactggcagccatcatgacccagaagtcccgggaaaaggcctgaggtgaaatgacgctgggtgaaagtataccggggatacccaatacgagggtgatgttgaaaacatttgagccgatgatattgcccatcgccatgtcattctcgcctttaatggccgccgcaatcgaagtggcaagttcaggcaggctggttcctaccgccagaattgtcaggccaataaccagctcactgatgccataaatacgtgcaaccaccgccgcattgtcaatcaccatgcgggtagaaatggggaggataatcaatcctaaaacaacccagagaagtgcgatgcctttgttaccttcgatgggtaattctgcatctcgttcctgcgtatagctgtctaggtcatcatcttgggaaactgttgtcattttgatcattagggcgataaagaacaagccggtaagtaacaggacgataccgtccaggcggttcaggtagctgtcggccagaatatagcctacaaatgcagtaatcagcaacatcagcggcaactcccgccgcaggatatctgatttcaccgtgatcggtcgaatgagtgacgcagcgccagtaatcagtagcagattggtaatattggaaccaatggcattgcctatagccatgttcggtagcccatcttgagctgctgtgatagacaccatcaattctggcagtgaagtgccgattcccatgattgtcaagccgacgatataggggggtattttcagtgagcgggcaaaaaccgcagcaccatatactaatctatcagagccatacaccagtaaaatcaacccggtaatgagcagggcaatagtcagaaacatggggtgttccttaaataaaatttattccgaacataatgctaataatggttgatttttaaacatgaaatgtttattcagctagacttatatattctgacggtcaagcggtaaaaagtaaaatttgtcataactttgctaacgcaaatttggcaatttttttgtagtatgcatgactgattatttaaaaacagtaagaaacaagttttattaacggttaggggctatcaaataatgagtcaacaaacagcaaatcttattgagatctgcggcatgtatttcactcgtggtcaacgcccgattttttctgatattaatctgaccgttccaaaaggaaaagtgactgccatcatggggccttcaggcatagggaaaactaccttgctgcgcctgattggtgggcagatccgccctgaacgcggcgagatctggtttgatggcgataatattccggcattgtctcgccaacgcctctatgctgcccgtaagaaaatgagcatgttatttcagtcaggtgcgttgtttacggatctgaatgtctttgacaatgtcgcctttcctttgcgtgagcatacccaattgcccgaagcgttgattcacaccacggtgatgatgaaactggaggctgtcgggctgcgtggggctgcgcacttgatgccatcggaattgtctggcggcatggctaggcgggctgcattggcgagggcgatagcactcgatcccgatctcattatgttcgatgaaccttttgttggtcaggaccccatcacgatgggcattctcgtcaaattaattgatgagcttaaccatgcgctcggtgtcacctgtgttgtggtttctcacgatgtacctgaagtattgagtattgctgattatgcttacattgtggctgagaagacggtcattgcagaaggtacaccggagcagttaagaatgaatcaggatcatcgggtacggcaattccttgatggcattgctgatgggccggtgcctttccgtttccctgcgggggattacaaaactgagttattaggataatggaatgttgatgttaacacgggcactggctgcgctgggcaaacgtgcgatcgaggttgcggcctcattcggccgtgctggctttatgcttttcagtgcaatcattggtaagccagaacccgccaaacaatggaaattattatgtcagcagctgtatagcgtcggtgttcagtcactgctgatcatcgtggtttccggcttgtttatcggtatggttctgagtttacagggctatctggttttaacgacattcagtgctgagggtagcctgggcatgatggtggctctgtcactgctgcgtgaattggggccagtcgtcacggcgctgttgtttgctggtcgggcgggttcagctttgaccgcagaaattggtttgatgaaagccacggagcaaatttccagcttggaaatgatggcgattgatccgctgcgtcgggtaattgctccgcgtttttgggctggttttatcagtatgcctttactctcgctgatctttgtcgccgttggaatcatcggaggcgcgatagtgggcgtggattggaaaggcattgatgctggttttttctggtcttcgatgcaatcggcggtggattggcaaaaagacttgctcaactgttttcttaagagcgtagcttttgccattacggtcacatggattgcactgttcaatggttatgatgctatcccaacatcagaagggatcagcagggcgacgacgcgcacagtagttcatgcgtcgttggcagtattgggtttggattttgtgctgacagcactgatgtttgggaactaagtcgatgcaaaacaagaaaaatgaaatttgggttggatgttttgtcttgattgcactggttgcaatcgtctttttatgtttgaaagtagctgatgttcggtcatttggtagccagacaacctatcgcgtatctgctgcatttgacaatattggtggactgaaagtgcgttcacccgtaaaaattggtggggttgtgattggtcgtgtagggcgaatctggctggatcgcaaaacctatactccacaggttgaactggatcttttcactcagtacgacaatattccaagtaccagctcgctttctattcggacatcagggctattgggcgagcaatatgttgcaatgaatgtgggtttttatgaccctgatatgggggtatccatgttgaaagggggagatcgtattgaggacaccaaatctgcaatggtgcttgaagatttgatcggtcagttcttatataaaagcggtgacggtggtcaggcaaaatctgattcagctccggcaccggcacattaatctgcaatccacggcttaggagagatagcatttatgtttaagcgattacttatggttgcgctgctggtggttgcaccattggccagcgcagttgatcaaaccaacccttacgcattgatgaaagatgcagcagaaaaaaccttcacccgtttgaagaatgatcagcctcaagttcaggcaaacccagaagttctgcgtcaaattgtgcgtgaagaactgttgccttatgtgcaggtaaaatatgcaggggcactggttcttggaacttactacgggcaggcgacgcctgaacagcgcgaagcctatttcaaggcgtttgaatcttatttagagcaggcatatggtcaggctctggcgatgtatcatggccagaactaccagattgcgccagaacagccattggagggcaagacgatagcggctatccgggtcactattactgatgaaaatggtcagccgcctgttcgcttggatttccagtggcgtaaaaatagcaagacaggttactggcaggcttatgacatgattgcggaaggcgtaagcatgatcacgaccaagcagaatgaatgggcagatatcctgcggcagaaagggattgatgctctgacagaacagttgaaaatcagcgcgaaaacgccaatcactttagaaaagaaaaagtgacatggaaaaccgggaaataagccaaacgtctgatgacggaaagataagttgggaacaaacaggaagtacactatttcttcacggtacactggatcgtgacagtttacttccgctttggcagcaaaaagacagcgttctggctgagatcaaaaatattgatgtttctcggcttgagcatgtggattccacgggactggcgttgtttgtccgcttaaaaggagacatgcagcaacgtggcaaactattaaccttttctggcataagtgaacgcttggagacattgatagcactttatggcctgaaaagtctctttggtgctaacacgcctgacatgtaattcccttttcccataatcatcgcccttgtaagtcaccctcttacaagggcgtttttcttggtttaagagtcgtctggattccattaggataggcgactattattatttttaacgacgagtgtgagcaaattatggatactgatgaaattaaagaagtgctgatgaaagcattggtacttgatgacgttatcgttagcggtgatggcagccattttcaggtgattgcagttggcgagctttttgatggcctgagccgtgtcaaacaacaacagactgtttacgcccctctgatggaatacattgctgataatcgcattcatgccgtgtcgatcaagacttatacacctgcaaagtggcaacgtgaccgcaagcttcagggattttgaggttgtttgcctcgccgcgaacagcacactttgaattaaacaagagaatgaagatggataaatttcgagtgaaagggcctacctgcttatcgggtgaggttactatttccggggcaaaaaatgccgcattacccattctgtttgcagcgctgctggcggaagagccagttgaattacagaatgtgcctaaattaaaagatattgataccaccatcaaactgctcaaccgtttgggaaccaaagtaaaacgcaatggctctgtttttgttgatgccagtaacgttaacgaatactgcgcgccttatgaactggtcaaaacgatgcgggcttccatttgggccttggggccgctggtcgcgcgtttcggtcaagggcaggtatcactgccgggtggctgtgccattggcgctcgccctgttgatctgcacatttctgggctggaacagctcggtgcgaaaattgttctcaatgaaggttacgtcaaggcttccgtcgatggtcgcttgaaaggtgccagtattgttatggataaagtcagtgtgggtgcgaccgtcaccatcatgaccgcagcgacactggcggaagggacaaccatcattgaaaacgcagctcgtgagcctgaaatcgaagatactgccgattttctgaatacactgggcgcgaaaattaccggtgcaggcaccgatcgcattgtgattgaaggtgtagagcgtctgggaggcggtgtttatcgtgtgctgcctgatcgtatcgaaacaggaacgttccttgtcgctggtgccatttcccgtggcaaggtgatttgccgtaataccaagccgaacacattggatgccgttttatccaaactgcgtgaagccggggcagacattcaggtgggagatgattggattagccttgatatgcacggcaagcgaccaaaggcggttacattccgcaccgccccgcatccgggcttcccgacggatatgcaggctcaattcagcttgttgaacatggttgccgaaggtgttggcatgatcactgaaactatctttgaaaatcgcttcatgcacattccagagttgattcgcatgggtgcgcgtgcagaaatcgagagtaatacggtagtttgtcacggtgttgaaaatttatctggtgctcaggttatggcgactgatttgcgtgcctctgcgagcttggtattggctggctgtattgctgaaggcaccacggtagtcgatcgtatttatcatattgaccgaggctacgagcatatcgaagataaactgcgtggtttaggtgcgaatatcgagcgtattaagtcgactgattaaattgaactcatattatccttcgcccgaactgggcgaaggattgaataagcgaaaagcagcggagttgtcggctatactcttcatcttgcaagctgctacaggcgttaaatgctaaattcttcagccgtcaaattcttcaaccataaccttgaaggtgagggattgcccatcacgcagcatggtgatgggaaccatactgccagggcggatatcagtgacttgatccatcgtctctgccggagaaatcgcgggttggtgattgaaattagtaatgatatctcccactttgatccccactttttgagccgggcttctcggtgcaacttcaaaaacccgcaaccccgacatttggttgatattgctgtctgacgagcgaatacggggtaaatcttggactgtgataccaatatatcccctgatgacccgcccatcgcggatgagtttatgcatgattttcgtggcaagttcggtaggaatggcaaaccccaagccttcaggcgtgacaccaaattctgacttatcaaacgtcagcgtattgatcccgactaattcccccagcgtattgaccagtgcaccgccggagcttccctgattaattgaagcatctgtttgtagaaaattctggcggcgtgtagggctgaggctaacacgccctgtcgcactgataataccttgagtgatggtttgccctaaattgtaaggattgccgattgccagcacgatatctcctacatgggcaactcgattgtgattgatcgggatcacggggagatttttaccattgacctttaagacagccagatcggttggagcatccgagccggccagcagcgcctcatagaatcgaccatcttgtaatgcaacaataatagagtcggctttattgatgacatgtttgttagtgaggatatagccctggtcattcatgatgacgccagaacccaaggggcgaagttcccggccttcatgagaaaaactacccagattactgctgtagatattgacaacagcgggagccgctcgacgaactccttgattgaaactgtatggtttgccgttgcgactattgtcactcaggagatgttttaacccattggggcgtagtgaaggtatggtaaccaataagattgcagcaatgagtagtcctatcgatatggagcgcaataacttgatcagcatggcattattcagtaataaataagtgaaagaagcatagcatagaagcgaacagacacagcttatgctgtgtctgtcagtaatactagatcgcgttttttatcttcaattgattaattacgcagtaacaagtagatattatcatcaccacgtaaaatgttcagggcaataacaggtggttttgtctcaagcagtttacgcagctcgctgatattccgaattcgctcgttattggctcctataatcaaatcatcattctgtaagccagacattgcggcaggtgaattctgggtaattttatctactttcacaccttgtgtgtttttcactgtgctgttgctcagaattgcaccttgcagggcaacgctcaagttttcagctttggtttcttgagttacattattttctagtgttacggtcacttccattggcctccctttacgcagaaggccaatcttgattgctttaccgggagcggttgtaccaaccttcgcacgcaattcagcgaagctggtgatttttttgccgtcaacggagaccagtacatcccctggcttgatgtcagctttagccgcagccgatttaggaatgacttcgctgacgaatgcaccttgttgagcatcaacgttgagtgccttggcgacatctgctgtcatctcggttcccttgataccgagtaggccgcgcttgacttcaccgtgggcaatgagctggtctgcaaggttgctggccatgttacttgggatggcaaaaccaatgccgatgttaccgccgccgggagcgaggatcgcagtgttaatgccgatcaattcccctttcaggttgatcaatgctccacctgagttacctcggttgatagaggcatcggtctggatgaagttttccaaaccttccagattcaggccactgcggccaagggcagagatgatccccgatgttacggtctgccccagcccgaatgggttgccgatggcgacggaataatcccctacacgcagttgatcagaatcggcgaatttaatggctgtcaggttcttggcatcttgcagctgtaaaagtgcgatgtcagtctgtaggtcacgcccgatgagttttgcggaatattcacggccatcgtttaattgaactcggattttattggctttctcgataacatggctattggtcagcacataccctttattggcattgataataaccccagagcctaatcctttgaatggacggcttctttgctcctgtggaggaaaacctggcccaaagaaaaattgaaagtcttctggtaactgaagctgctgctgattttgaacttctgtgcccgagacatgcacagtcactacggaaggaagaactttttccagcattggcgcgaggctcggtaattcctgagaagccactgcggcaggtaaagctgcgttacctaccactggaactgaagctaaagataatccaatactgatcgcaagtgcgctgagcaatgtgttttttcttttcattgaatacgttctcttaatacctaagccagaaagggaaatcgtacttaaaagacctatcctgtcaggaaatttcattttccttgggaattacgcttattgggataggttttaagcataattgtttcgatgctgttatgactctcaattattcagcaaagttcactaacaatgtcgttttgccgtgtttctttacaggtatttacgtgaattaaaattaaaaaacaaaactctttaatgtcaagaaagccaatgagccgtggtatcaacaggttaccacggccggagaatttactgttttttatcttgaattgggcggaataggccggatgcaccctcagaatagtcccgtggaggcatattggcggtgactttacttttatcggcttcagattcagtcaggcgataattgaagggattatcctgtattggcatgtttggcatcagttcgttggaacttttggccatgtgctgatacagttggcgataatcgcgtgccatattatcaagtaattcagcactgtgggcaaaatggctgaccagctccttacgatattcttccaactctgcccgattcttctccagttcggcctgtgctgcattttgctgacgcagttttgaactgccaaagcggacagccagtgcgccaacgataaaaccaataactaacccaatcagtgcatattcccaagtcatggcaacccctttattaacttcagtgttcggcaatagtgttccacaatgtctcaataccattgctatcactataaccgctaattaagtcagagtggaatattgattattaattaatttatacaccacttgatgtgtcaattttatacaaatttgcgatgatacgtcgtgagttattggcgaaattgagagaggatatggaaaaaagtatgaaaaattggaacaaatataacgaactcaaacagaaaagattagcgcgatttttaccagtacaatgaatcgtgctgagaacaaaaatttttaaggattgtcattttgatgttaccgattacaccttcgtctctctatcaatctgcactgtcagaaggccagtaccaacctgatgaagtgcagcgtaataccgttgcccgcttggatattatgcatcacgatctcagtaatcgttctccggagcatgttttaccttcaagtggactgaaaagcatactgggcaggttatttggcggcttatcaacagagcagcagcggccggttcaggggctttatatgtggggcggcgtcgggcgtgggaaaacatggttgatggatatgtttttccagagcctgccaaccgaccgaaaactacgtctccattttcatcgttttatgttgcgggtacatgaagaattaaccgttttacaggggcacgaaaatcccttggatgtgatagctgatggctttaaggcgcagactgatgtgctctgcttcgatgagttttttgtttcggacattacagatgccatgatcctcggtaccttgctggaagctctgtttaagcgaggaattgccttggtggcaacatcaaatattccacctgatgaattgtaccgaaatggcttgcagcgcgcgcggttcctgccagccattgagcaaatcaaaaaatactgcgatgtgatgaatgtggatgcgggtatcgattatcggttgcgcacgctgactcaggcgcatctttatctcacgccattatcggaagataaccgacaggaaatgcatcgcatgtttcagcgtctggcgggacggaaaggagaaccgaatccggtattggagattaaccatcgcagtatgcctgccatcagcagtgttgacggggtgctggccatcaatttcaaaaccttgtgtgacgatccccgcagtccgttggattacattgcgttgtcgaagctttatcattctgtcctgctgcatgatacgccagctatgactgcattggatgaaagcgcagctcggcgttttcttgcattggtggatgaattctatgaacgccatgtaaaactcatcatcaatgctgaagcgccgatggagcggatttatcaaggggaattgctgacatttgaatatcggcgttgtctgtcccgcttgcaggagatgcagagtgaggaatatttgaaacttcctcatttgccctgatatctggctttgatccgtaagaaaaatcgagattgtcgttatctggcaggataattattgaattgggggtcgattttttatgatgacttctctataatcttgcgaccccacgttacagcaagatttttttcccaaaaacttgcatcagtgccggcataggctattcgaaggggtaggtttgctggacaaaagtcgtgtgaacctcaaaaacagtttctgaacatcgagtgttcaccaacgtgtaacttataattgggtaagctttaatgaaaacttttacagctaaaccagaaaccgtaaaacgcgactggtatgttgttgacgcagatggcaaaactttaggccgtcttgcaactgaaatcgctagtcgcctgcgcggcaagcataaagcggaatatactccgcacgttgatactggtgattacatcattattgttaacgccgaaaaagttgctgtaactggcaacaaacgtgctgacaaaatctactatcaccacactggccacatcggtggtatcaagcaagcgacctttgaagagatgattgcccgccgtcctgagcgtgtcattgaaatcgcggttaaaggcatgctgccaaaagggccactgggtcgtgcaatgtaccgtaaactgaaagtttacgcgggcagcgagcacaaccacgcggcacagcaaccacaagttctggacatttaatcgggattataggcaatggctgaaaatcaatactacggcactggtcgccgcaaaagctcctccgctcgtgtctttattaagccaggtagcggtaacatcgtaatcaaccaacgtagcctcgaagtttacttcggtcgtgaaactgcacgcatggttgttcgtcagccactggagttggttgacatgttaggcaaactggatctgtacatcactgttaaaggtggtggtatttctggtcaggcaggcgcaatccgtcacggtatcacccgtgcactgatggcttatgacgagactctgcgttctgatcttcgcaaagctggcttcgttactcgcgatgctcgtgaagttgaacgtaaaaaagtgggtctgcgcaaagcacgtcgtcgtccacagttctccaaacgttaatttgttgccacggctgtggcgatgggttaaagttgaaacccgtcatttatatggcgggtttttttatcatctgattttccttcctttggtgaatagccttttttcccaaaaactagcgtattacagaaataaataactagattctgatatttcatcattaattctcaatgtacttccccacaaaatgtgcaaaatctggtagactagtgataattttttgccttatccatgaatgagcctgatttggcaggggtttcaatataccctcggataataagtgcgaaacaggatgagaatatgagcgagaatagccgtttttcactgaagggctgttcgttcctttgtttagataaacttggaggttttcatggctgtcgctgccaacaaacgttcggtaatgactctgttttccggctcgaccgacatttttagccatcaagtgcgaattgtgctggcggaaaaaggagtcagcgttgagattgaacacgttgaagcaggcaatttgcctcaggatttaattgatctgaatccttatcagacggttcctactctcgttgatcgtgaattgactctgtatgattctcgcatcattatggaatatctggatgagcgttttccacatccaccactcatgcctgtatatccggttgcacgtggtagcagccgtttgatgatgtatagaattgaaaaaaactggtattccctgatgtataaaattcagggagggaatactcaggaaaccaatgctgcccggaaacagcttgctgaagaattattggccatggcgcctattttcagagacatgcctttcttcatgagtgaagagtttagtctggtggattgctacctttcgccgctgctgtggcgtttgcctgtattaggtgtagagttgtctgggccaggtgcaaaagatatccaggtctatatgcagcgtgtatttgaacgtgacgcatttttggcttcactgacggaagcagaacgtgaaatgcgtttaccatcacggggctaatttatggagatgattcaaatgtctccacgtcgtccttatttattgcgggcgcattatgaatggctgctggataatgaaatgactccgcatcttgtcgtggatgtcaccctgtatggggtgaatgtcccgatggaatatgcgaacgatgggcaaatcatcctgaatatttcgccgagggctgttggcaatctggaattgactaacgatgaagttcggttcaatgcccgctttggtggtgtagggcgtcaggtctctgttccaatggcggcagtgattgcggtttatggtcgtgaaaatggagcaggaatgatgtttgagccggaatctgcctataaggtaggtttcgaaccggaagattcggatgctcctatagcggataatctggtgcttatcagtgacgctaaaattgctcgtgataatggttcatcggatgacgaaccccctcaacctccaaaaggtcgtccaactttgcgtgttgtaaaataaacaggcaactaggtacagttacaatatagaaaataaaggagattttggtctcctttattatttttagtggtacccgcttttatagaggcactcgtctgggaatcaaaaatgtactataaagtttgagctagtctccatagtctccacaggcaattttctatattttcattattttttccggaattagattttctggctgcattcaggctgttagacagcttttcaataaaacttgtcctttcgtccaagccttttaaagttggcggtatatcgcagatctgatctgatgagaatgaattatattttttcgacagcgataagacttctacagggttattaattaaggcaaaagataaagagcaaaggagttgtttcgaaaattcggaatgcatattgggggatagcgtaaatgcaactctcagccactgactttcacctgttgtaatgttataggcgatttcatccctttttctactttctcctaattccgcaacaacggcatttacacctctttctcgcacttgttgcaggatttccgcttgtgtcgataaatgagcaattgagggtgagctcattaaggatatgaaagagaataaaagtatctgtgtgagtaagcgcatctatttcttccagtcattgtcaattaatagttattaattaattaactattatttaatctttgtttggatatcgtttaactaattgcactaaaaaatcgtcttctctttgagaaaagaaataagattttttgctgtattaacacagtaagattaaatcggaatatttacctttaggttataagaatagtcgcataaagcaaaaaaatacaactaatatgggagtaaagaagagataaaagtgaactcgtttctaaatttttgaaattttctccggtcaaaaggccggagaaataatggaagaaacagtgggtagggattaaacctcaagatagtcgagaataccggatgccgcttttctaccttctgcaatcgcagtaaccactaaatcggagccacgaacggcgtccccgcctgcgaatattttaggattgctggtttggaagggaagatcgctggcttcaggagcaacaatacgtccctgctgatcgagattgatctgatgcgcgttcagccagtgcatgttgtgaggtttgaaaccaaacgccgtgattacggcatcagtttcgatcaaaaattcggagccctgaatgatttcagctcgacggcggcctttttcgtccatttcgccaagttgtgttttcgcgactttgacgccgcaaacttgacctgcgctactgatctcaatactgagcggctgaaggttaaactgaaaatccacaccttcttccttggcatttttcacttcacgacgggagcctggcatattgccttcatcccgccgataagcacagatgacatgggttgcgccttggcgaacagaagtgcgcacgcaatccattgctgtatcaccgcctccaagtaccagaacgcgctgacctttcatatcaacataaggctgtttcggtaacgcggggtagcccattaaatgacgggtattggcgattaagaagggcagggcgtcatagactccgtcagcatcttcgttctcgagtccgccatgaatagactgataagttcccacgcccagaaacacagcatcaaattgctcggtgagttcagcaagcgtgatgtctttgcctatccccgtgtttaagcggaattcgatacccatttcggagaagatttcacggcggcggatcatcacctctttttccagtttgaaagcaggaatgccaaacgtgagcaagccgccaatttcagggtggcgatcgtaaactaccgcttgtacgccgttgcgggttaggacatccgcacaggccagccccgcagggccggctccaatcactgccacacgtttgcctgtcgggatcacgtctgacatatccggcttccagcccatcgcaatggcggtgtcgttaatgtaacgttcaatattgccgatggtaacagcaccaaagtcatcattcagcgtacaggcaccttcacacaggcgatcttgcggacaaactcgtccgcagacttctggcaggctgttcgttcggtgggagagttccgccgcttcaataatccggccttcattcgcgagtttcagccagttcggaatatagttgtgcacagggcatttccactcacaatagggattcccacatgaaaggcagcgatctgcctgtgcctcaacttgcatttcagaaaaaggctcataaatttccacaaattctattttgcggattttcaacggtttttttgggggatcgacacgttgtaagtcgataaattgataaacgttctgactcatttttgactccttactgcgcctgaacccgtaattctgcggaagaacggctgcggtgccccaacaatgcactgacatcactggatttaggtttaaccagcgcgaatttattgacccattgtgaccagttttccagtatgctttcgccatgctgggagccagtcaatcggacgtgttcggtgatcaatccacgcaagtgttctttgtgaatggccaaggtatctattgagagtacttcgaccaattctgggttgactcgcttgcggaaatcatcaaattcatcaagaacgtaagcgaatccgccagtcatgccagcgccaaaattcacccctgtgctgcccagaacacagacgatcccaccggtcatatattcacagccattatcaccgatgccttcgataaccgtgatggcacctgagttgcgtacggcaaagcgctcgcctgcatttccggcggcaaacaattttccgcctgttgcaccataaagacaggtattaccgatgatggtcgcttcgttacttctgaatgcagaaccaaccggaggtcgaatgacaatttgacctcccgccatccccttgccgacgtaatcattggcatcgccagttaatgtcaattcgacgccacccgcattccagacgccaaaactttgtccggctgttcctgtgaagtataattttatgggatcggctgcgagcccctgatcaccatgcaactctgcgatttcacctgacagtgaggctccgacggaacgatcagtattttggatatcaaaatagagctttttactctgtgaatttttcacataaggcatagcctgcttgatgatatctttattcaaaataccctgatcaaatgacgggttatcttcagtacaatgcagatccttgccttcgtggggttgtgctgttttcagcagcggctcaaggttgagcttactttgcttggcagaaatgccttccaatatttgaagtaagtctgtccggccaatcagatccgttaattcccgtatgcccagttgcgccatgagctcacgtgtctcctgcgcaatgaaacggaagtaattgatcacgcgctcaggcagaccatgatagtgagacttgcgcaatttttcatcttgcgttgccacgccagtggcacagttattcagatggcagatccgcagatatttacacccgagggcaaccattggccccgtgccgaagccgaaactttccgcacctaaaatggcggccttaatgatatccacgcctgttttcaatccgccatcaacctgaaggcgtattttatggcgtagcccattggcgactagcgcctgttgagtttctaccagacccagctcccatggacagccggcatatttcactgatgacagcgggcttgcgccggttcctccgtcataaccggcaatggtgatcaaatccgcataggcttttgctacacccgtagcgatagttcctactcccggttctgaaaccagtttgactgaaatcagcgctttcggattgacttgcttaaggtcgaaaattaactgagccaaatcttcgatagaataaatatcgtgatgcggcggtggtgaaatcagcgtcacacccggcacggaataacgtagtttggcgatataaggcgttaccttatcccccggcaactggccgccttcccctggttttgctccttgggcaacttttatctggatcacatcagcactgctcagatacgcgggtgttaccccgaaacgtccggaagcgacttgtttaatgcgggacactttcttcgtgccataacgcgcaggatcttcccctccttcaccggaattggaaaaaccgcccagcgtattcatcgcctcagccagtgcttcatgcgcttcagggcttagggctccaattgacatggcagccgtgtcaaaacgtttgaacagggattcgtctggctcgacttcctcaatggcgatgggttcttctttagaggaaatggcgagcagatctcgcagagtcgtggcggggcggccgttcactaactgggaatatttctggtaatcactgtatttgccactgtgaacagccgcctgcaatgtattgacgacatcggggttataagcgtgatattccccatcatggacatatttcagcaatcccccttgatcaatggtatggcgatgtaaccacgcccgtttggagagattacgcagatcttgttcaaaatcgttgaaatctgccccttcaatacggctgacaacgccattgaaacaaagatctgtcacatcggaatgcaggccgacggcttcgaataatttggagcagcgataagaggaaatagtggaaatgcccattttggacataatcttatatagccctttattgatgccgttgcgatagttcagcataacgcggacatatggcgcgttgatcgtgccatcgtccaccatttttcccagtgactcatacgccagataggggtaaaccgcagtggcaccaaagcccaatagcacggcaaaatggtgtggatcgcgggcgctggcggtttctacgatcaggttagcatcacagcggagacttttctcaaccagacagtgctggatagctccgacagccatgggggcgggaataggcaatttttctggtgaaatattgcggtcagacagaaccagcaataccgccccgtttcggatcagttcttcagcttgtctgcacaacgttgcgacagcacttttgaggttggtttcctgtggattaaacgtcaaatccagtgtttcagcgtgatagtaggattcttgctgtgtcgtgagctgcacaaaatcagaatagagcagcacaggggactcaaaactcagccgatgcgcctgaccttccgcttcacaaaagacgttcatttcccgcccaatacgggtcgccagcgacatgacatgagcttcacgcagtggatcgatggggggattggtgacttgggcgaattgctgacgaaaatagtcataaatgacgcgtggacggctggaaagtaccgcaaacggagtatcatcccccattgagcccgtggcttcctgcccattctcaccgagtgcacggataatttgatccagctcttcattgctgtaggcaaattgtttgtgataaatcgccagcatccgatcatctaaatcacgctgaccgatttgatcttccggcagtttctcaaatgggatcagttgtttgacgtttttttccagccactctttgtaaggatggcggattttcaaatcattatcggtttcagcggaatggagaatgcggccttcataggtgtcgattaccattaactcacctgggccaacgcgtcctttttctacgacttcatcaggttggtagtcccaaatgcccacttcggaagcacaagtgatcagcttatctttggtaatcacataacgggcggggcgcaggccgttgcgatccaaattacaggctgcatagcgtccatcggaaatcacgatgccagcaggcccatcccacggctccatgtgcatggagttgaagtcgaagaatgcacgcaggtcatcatccatatcaggattattttgccatgcgggaggaactagcaggcgcattgcccgaattaaatccatgccgccattgaggaacaattccagcatattgtccagtgaactggaatctgagccagtttcattgacgaaaggcgcagcggtttgtaagtcggggattagtggtgtccggaatttataggctcttgctcttgcccattcgcgattgccggtgatggtattgatttccccgttgtgggcgagatagcgaaacggttgtgccagcggccagcgaggaactgtattggttgaaaatctttggtgaaataggcagatagaagattccatccgcaaatccgccaaatcgaggtagaagcgcggcaaatcagcagccatgcacagtcctttgtaaatcgtgacgagattggacaggctgcaaacataaaaatcgtcatcagtgatgcgtttctctatacggcgtcgggcaacgaacaaacggcgttccagatcttgcgcccgccatccggccggggcattgacaaaaatctgctcaatacgagggaggcttgacagggcaatctcgcccaaaatatcgcggttgatggggacttcccgccaacccacaatggacagggtttcgttttgtaattcttgttcgacaatgtcacgacatgattgggcaattttggcatcctgacttaaaaacagcatgccgacagcgtagtttttggcgagccgccatgactgatcgctggcgatcatctgaaaaaaccgatctggcttttgcattaataagccgcagccatcgcccgttttgccgtctgccagaattgcgccgcgatgctgcatccgagccagcgcatgtatggccgtgcgcacaaccttgtggctttgctccccttcaatatgcgcaattaatccaaagccacagttatctttttcctgcaatttatcatacaacatggtagagctccccaaggtctgtccgactctcacatcacccgcaaggtgatataggtatatattattgctacaggcgtctgatttgcgccctcagctaaacaccacttgctttattggcaataacaagcggtaaatcaaaatgatgttatgtcactgcataaggacactgcataaatatgagtcggagaattatccgacaagtgattttcagtggattcccaacttagcgagaaaaatagagcaggtcaaatcgtgctagatcgcgttttttacaacaggaataattatatctatttgaattaaaataaaaataatcgtcattttgtattttgtgactgagatcattaatctgagatgttgtgagctatatcactaaatactgcataatatttattttaaatattcttttaaaatgtattattgcgatattttaatcttaattaattttatttaatggaattaagttgtgtattttatgttgactgagaataaataattgattgctttttgttctaaaataatttttaaaataaatatcgattaattattctatttttatgactatttattcttgtgggtgttggggtgatatccctcaacaaagttgagtttgttttacgttatgattcaatctggtgattttacttggagttgttatgaagcggatcaggagatttgcccagtattatgtcgatttgatgatgaaattagggctggtgcgtttttcgttactgcttgcatctgttctcattatccttgcgatggtgatacagatagcaatcactttacactggcgtggagaagtacaacgaactgatttaattggttccatcttttttggtttattgatcacgccttgggcggtttattttctttccatcgtggtggagcaacttgaagaatcccgccaacgtttatccagcctggtcgcaaaactggaggaaatgcgtcagcgggatgccaaattgaacctgcaacttaaagaaaatattgctcaattaaatcatgaaatcaatgacagagaaaaagcagaaaaaacgcatctggtactgttggataaattaaagtcggaaatggaacagcgtgaaaaaacccagagtgcacttgagcagcaatcgattctgctgcgttcatttcttgatgcttctcccgacttggtttattaccgtaatgaagacaatgaattttccggttgtaaccgtgcgatggaactgctgacgggcaaaagtgaaaaacaacttatcggcctgacaccgacggaggtttacgacaaagaagtcgccagtaaggtgatggaaaccgatgaaaaagtgtttcgtcacaatgtatcgttgacttacgaacagtggttggtttatcccgatgcacgtaaagcctgttttgaactcagaaaagttcctttttatgatcgcgttggaaaaaggcacggtctgatggggtttgggcgcgatataacggaacgtaaacgctaccaggacgcgttggagaatgccagcagggataagacgacctttatctcaacgattagccatgagcttcgtacgcctttgaatggcattgttggtctgagtcgcatcctgatggacactgatctgacgccagaacagtgtaagtatctgaaaactatccatgtcagtgctatcactcttggtaatattttcaatgatattattgagttggataaaattgagcgccgtaaagtccagcttgataaccagcagattgacttcacgggctttatggctgatttggaaaacctgtcagggctactggcgcagccgaaaggcattcggtttgtactggaaccggaattaccattgcccgccaaaattttgactgatggcacccgtttgcggcaaatcttgtggaacctgatcggcaatgccgtgaaatttactcagaaaggcgagattcgggttcgtatctggcgtgaaggaggcgagcggctgttatttgaagtcaccgattccggaattggcattccttctagtgagttggaaaaaattttcgccatgtattatcaggtaacagacagtgcgggtgggcgcccggcaaccggaaccggtatcgggcttgccgtctctaaacgccttgcccaaagcatggggggagatattgtcgtggaaagcacagtggatcaaggctcctgttttacattgtctattgttgcccctgctgttgatgaaaaatcagaaggacaagaagagagcgaattgccattgcctgcactcaacatcctgttggttgaagatattgaactgaacgttattgttgcccgctccgttctggagaaattgggaaatagcgtcgatgttgccatgaatggtcatgacgcattgatgatgtttgatcctgatgaatatgacttagtgttacttgatattcagttgccggatatgactgggctggatattgcccgtcaattacaccagcgctatccaagccagtcacttcctccattggttgcgttgactgccaatgtgttgaaggataaaagagaatatcttgatgtgggaatggatgatgtgctcagtaagccgctctctgtcaaggagttaaccgccgtgatggagaaattctggggtaaggcgcctaagcctgaacagacattacaggagacaaaggttgtgaagaagaacgaagatttacttgatacagagatgctcaatcaatatatcgatttggtcgggccaaaaatgattgctgataacctgaaaatgtttgaaaccatgatgccaagttatcttgccttgttggattcaaacatgaccgcgagggatcagaaagggatcacggaggaggcccataaaatcaagggagcggcgggttctgttggattacgtcacttacagcaattggcacagcagattcaatcacctgatttacctgcatggtgggataacgttcaagaatgggtggatgagttaaaattggaatggagaagtgatacggaaacattgagaaactggttaactgacgctacaaaaaaataaccccaaccgaagttggggtgcgcgaatactgcgccaacaccagggaaacttgtctacccgcttatctaaaatttattttcagcgcgagtagttaaaaaattcttccgtactgaacacaggtaccaacatagcaaagataagattttttgttacaagattcattaaaatctgtgatgaagattggtgtttaaccctctaaggggttaagcattaatctactacaaatggagataaatatgaaatgcgttgcagttatattaagtgggtgcggagtctatgacggaagtgaaattcacgaatcagtcctgactatgctctctttaagtcgcttgggtgctaaagtgtcttttttttcacctgatgaattacaacatcatgtaattaatcaccttaatggaaaggaggaaaaagaaactcgccacataatgcaggagtctgctcgaataacacgcggaaatatccagcctttatctcaggttgatattaataccttggatgcgctgattattcctggtggttttggcgtcgctaagaatttgtgtaatttcgcatttaaaggatcagaatgtgaaataaataaaaatttattaagtatagtgcgttctatgcatcagcagggtaaacctatggggttcatgtgcattgctcccgtcatggtagctaaaatattaggcaggccgataaaagtaaccatcggtaatgacccagaaactgcggcacaaatagaggcaatgggaggaattcacattgagtgcccagttgatgacattgttattgattttaaaaacaaaattgtaacaactccagcctatatgcttgcggaatctctatctcaggctgaacaaggaattgataaattggttcgcaaaatattggaaatgattgagtaatcggatgaaaaatcctttttcaatattgtggccctggttgaaaaaaattgtgcttacgatcacaattctgtggttcgttgctgtaattttgttttcgtttctgccggtgccgttttctatggtaatggcagagcgtcaaattagcgccttaatgtcaattaatttatcttatgtttcccgttcctcatggatggatcagaatcaaatttcaccttatatgacattagccgtcattgcggccgaagatcaaaagtttccaaaacattggggattggattttgaggctatcgaaacggcgatggcacataataaaaaatttcagaagcggatacgtggcgcttccactattacccagcaaaccgccaagaatttgttcttgtgggaagggcgcagttgggtgagaaagggattggaagcagggatggccgttgttttggaattgttatggtcaaagaaacgtattttgacggtctatctcaatattgctgaatttggtcatggcatttttggtgtggaagaggcggcacggcattattttggtaaatcggccaatcgtttgactgcctctgaagcggcattactggcagcggtgttacccaatcctcatcgttataaagttgatgcgccttcagcttacttgttgcagcgtcagcagtggattttgcggcaaatgcggctgctagggggagaaagttatctgaaacaaaataaattgagatagcaatgagatgctcaaataaaagcggcactgacttgtgccgctatacgtacagttgatgttcaacgggatctcaattgagataagtgaatgccgttgtcacgcgcttaacaccgctggtttcactggctatcttcgcagcatctgtaccttcctgtctggtgacaataccaaacaaaaagacttcaccattttcagtgacgaccttgatattcgatgacttcactgaatcactggctaaaatcttggaacgtactttggttgtcagccaagtgtctacagaggccgtacccaggtcaacaggattaccttgacggacttcgttatataccgcttcagtgccttcgacctttgaggcgagctgttttgcccgatcacccagttgcagatccgggctttgtccagttagcagcactctaccctgataaacagtcacaattatgcgggcttgtgccttaatttgtggatctttgctgatggcattactgacgcgggcttccagagtgccatcgtcaacctgttgaccaattgaccggggatcactacccgcttttgtcgcaatcgcggcagaacccacgacggcggcaccaatacatccctgcaataacattgcactgcaaaatactattaatagagaaaatagccgcattatttagctccttagtcatcctgatgaggaaataacgtattatcgattaagtcgcacagacagttaattgtcagcatgtgaacttcttgaattctgatactgtgatgcgaagggatgcggatttctacatcctgtggtcccagtaagcctgctagttcaccaccatcataaccggtcagtgcgacaatcgtcatatcgcgcgtgacagccgcttccaccgccttgatgatatcccggctgtttccgtgcgtagagatggcaagcagaacgtctccagcatgtcccagcgctctgacctgtttggcgtagatttcgtctggctgtttactgttggcgatggaagtgatcaccacgttatcagcattcagagacagagctggcaggcttggccgctctgtctcaaatcggtttatcatactggcggcaaaacgctgtgctgtcgcggcagagccgccattgccacagcaaaggattttgttgccattcagcagtgattgaaccatcatcattgcggcgcgtgatatcgcgtcgggcaatgcttctgctgctgcgatttgagtttgaatactttctgtaaagcagactttaattctatccagcacgttatgacctatatattgataatctattttatgtagagagtgatagcctatatacccttcatctttcaagctgcaacttgaaatctattgggtatagcaataggttttcattcaggtgaaggcattttttagccattcaaatttctgacctgtaattgcacaaatatcaaagcgacacgaggccgtttccagacactcgttgcgttgatacagccagacagaagctgtatacaatatttttctgcgcttgctctgggtaattgtagcaatggcatcaccatatgttgcgttttggcggaaacgaacctcgacaaatacccatgtctgtttatcacgcataatcagatcaatttccccaccccgaattttcacattctctgcaacaaagacaagcccctgttgttgcagaaactgtttaacctgctgctcgtaatagcgtccttgcgcatagcgattgatgcttggttttttcatcctgaaatgaccattaaaacgaaaatattatattgattggctaacaagccagtgacgttggggcgcgtcataatgcaatagtgatcgcgcccatttttatgttacttacggcattaattgtactgagttactgctgtcagtgcttttattaacggtgttgtcgacagtggcgtcaatattattggccgcattattctcgatagtgatacggccgttgttaaactgcatccacgccagctggcgtaatattatacaattatttgtgacggaaagctctcccgacgcccccttcatatggaatccggtgccttgctgtagctgtgtaaactgattggccagtgaccatgcatctatgcccatggcatagagacggatcagggaatagtcattggcaaatttactggcggcctgttgcattaatggcaaattgacgcctgtcagcaatggaatgtcactaaactgcataccgtccatttccagacggaaatccggccctacacccgccttattactgcgtgaattagcatagagtgcgggtttcttacgggaactgattgccatatcgatcattggcttgatgagggtcagttcatccgttgtcgctgcaatgtaaacggcatcgacggcaccaccggcagaatttgtaggggcgcttgtggcgatcactgctccgttcgttttgagctgtgatgcccccgcacctggcaggtaagcgctgactggaatgggcgtaccagatagacgaatgcccataccccggttgatggattgcttcatttcacccagtgtcccgaaagtctgttgtaaagccacattaccgcccaatttctgccattcttctgcaaaggctttggttactcgattacctagctcggtacgtggcactaataccaatggattgcgtttttgctgctgccagagatgcaaagccgcatttttagcttcatcttcaggagacagggagaaatagcagatattagaccgcgattgtgaaacgtccagttcgttgagcgcgagaatgttcaatggcgtattaatttgtaccaattgctccacattcggtttcagcaatggtccaacgaccagcgtaacaccatcttgttcagcttgtgccagcaggttggcaagtggctggctgttggtgtcataaactttcaccggctgatcgttgaccggagcagcagcaatagtggttgaagttgctgaggctggagaagatgatagtgcggcttcagccgtttcagtcgtatttgctgctatccctgcttctggcgctgatacggtagcatttacaggcaaagttggctgtggcagtcctttttgtgcatcaaggaagccttggcggattgcctcaccgaacacttttgcctgaccgctcagggggaggaatagcccgataatggcatggctgtcctttggcttgagcagcatttgttgcagcgaagtgggcaagctccgcatagccgggttatctggatagcgggtacgccagtcattgatggcagtacgtagcttatctagatcttgtttattgacgagataggcattgagtaggtcgagccagccctgaagcgtatactcattggcattaatcaccagttcgcccaactgttgcggggaaagatgcgtcagtgcctgccatgtatcatcaatgtttttctggtgagcagcgtcgtctgcggtatgtgtttccagcgcaatataagcgcggataacatccaaagacggttgattgtgagttgcatcaataatggactgatagcggttaatctctgcgctgatcttgtcttgtggcttagaaggtggttgcccttgctgttctggcgtggtacaccctgcaataatcatagtcgacagcagcgctgtgcagactaaaccagttttgaaacgcacaaaaattgagggaagcatactgtatccagtgatgtttttttcaaagatgctcaattttaaatcggtcattcggatgaaacaatgaatcaaaccaatcgagcagtggttacgacatccacgctatatgttgtgccaacccctatcggaaaccttggggatatcactcagcgcgcacttgaagttcttaaacatgtcgatctaattgcagccgaagatacgcgacacactggcctattgcttcaacattttgccattaatgcgcgcatgttcgcacttcatgatcataatgaacagcagaaagcagatcaaatacttgcgaaattagagcaaggtttgagcattgctctcgtgtctgatgcaggaacaccattaatcaacgatccgggctatcacgttgtccgccgttgccgtgaagcgggcattaatgtggttccactgccaggtccctgtgcggcgatcaccgcgctgtctgctgccggattgccttccgatcgtttttgctacgaaggttttctgccggcaaaaagtaagggacgccgggatacactgcgcgatttggcgcaggagccgcgaacgctgatcttctatgaatcgacacatcgtctgttggacagtttagaagatatggtggaagtgtggggcgctgatcgttatgtcgtgctggcgcgggagctgaccaaaacgtgggaatccattaagggcatgcctgtgggtgagcttttggcatggatcagagaagatgaaacccgtcgccggggagaaatggtactgattgttgaaggctatcgtaaaccggcggaagattgcctgccgccagaagccctacagacactggcactgctgcaaaaagagctgcccttgaagaaggcggcggcattggcggcggagattcatggcgtgaagaaaaatgcactgtatcgccatgcccttgagcaaatcgaagaaggtgtgtgaaaaggcctatacatcggatatcaaaccccttataatccgcgccggagttgactagacagtcgctgctttaccgctctccttcgggagatgtaaaggggaggaaagtccgggctccacagggcagggtgccagataacgtctggggggtgaaaacctacgactagtgcaacagagagcaaaccgccgatggcccacttttgtttgcaaaaataagggtgggatcaggtaagggtgaaagggtgcggtaagagcgcaccgcgcggctggcaacagtccgtggcacggtaaactccacccggagcaagaccaaatagaggttcacatggtacggcccgtactgaacccgggtaggttgcttgagccagcgcgcaagttctggcctagatgaatgattgtccacgacagaacccggcttatcggtcaactccaccagattccgccctatagagctttggctttatagggcttattctttttcagggcattttcagggcagatgaaaatgtgctgtcagagtatgaaaatcagccacccaaatcgattagcagcccctgaaatggtgtgtctgcccgcagttttagcagcagttcttcctgaataaataccccatccccacatttgatttccacgctggcatgattgctgccgctgatctttgcattgccacggatggattgcaggtaagcattttttccccgcaaaggcagagtttgtgtatcactggccttgatcaccagatagcttacccatacctgttggcgcaggtacatgctcttgttttctgacgaaggagaggccagtaatgttaatggtcggtttggcagtactgtgcgttgcaacggttgtggctcctgttccgggcaggcattgagccagagttgcaggcgtgtcagcgggatttcatcgctgatattatgctcactgtagagaatgccctgacgggcggaaaacagcaggcagtctccttggcgtgcatgaatatgagttccctcactgtcacggtattgggcttccccttgcaggataatattcagaatatcgacgtggggatacgcttttggctgaaattcagccttaggcgcaaggacttcctgattaaggacacgcagtgctccatagttcaaaaattttgggtcgaaatagtgtccgaatgaaaaagtatagcgggattttagccagccataatcggctttaccgcattggtttgctgttctagttattatcatgaccgtcatctccttgccaatatgcccgtcatctttcaagttgcagcttgaaatctattgggtataaacctaattttgcttgatcttaattatctggacgttgaaatgttagccagttaatctggttactatattcaaaattactgattgagaaaaagatgggtaaagaacgagcgcttacattggaatccctgcgcgtcatggatgcgatagaccgacggggaagttttgcggcagcggcggatgaattagggcgcgtgccttctgcattaagctataccatgcagaaattggaagatgagctggatgttgtgttgttcgatcgatcgggccatcgcacgaaatttaccaatgttggccggatgttgttggagcgggggcggttactgctcgaagcagcagataagcttacggcagatgcagaagcccttgcccgtggatgggaaactcacctgactatcgtctgtgaggcgttgtttcccgttgtatcgctgttcccccttgtggataaactggcgaaaaaatcgaatacacagttctcattaatgacggaagtgctggcaggggcttgggaacggctggaaacggggtatgctgatattgttatcgcaccagatatccatttcaggccatctgcggaaatcaattcacgcacgctttattccatcaataacgtctatgttgccagtgtggatcatcctatccaccatgaaccagaacctttgtctgatgccacgcgggtcaagtaccgtggaatagcggttgctgatacggcaagggagcgccctgtgctgacagtgaaattattggataaacaagcgcgattaactgtcagtacgctggaggacaaacgtcgtgcactgttggcgggtttgggggtagcaacgatgccatacccgatggtagagcaggacattgccgaaaaacgactacgggttattggttcggaatacagccatgaaaccaacatcatcatggcatggcggcgcgatagtatgggcgaggccaagtcgtggtgcctgcgtgaaatacccaaactgtttatgaagcaataaaagatcaataaaattaagcccccttactgagaatcgacagtcaggggctttttacaatagaggataattttgaaatggctggtaattaccagtttttattcagtacgcggtcaatactgaattttccgggccccatcatcgccagtagcagataacctgcaccgatagccatatttttcaggaacatcgtttggttcatgccatctgaaaaatcgttatggaacagaaatgctgtcagaatacagaaaataaacgtaaatactgcagtggtacgcgtcagcagaccgaacagtacggcaaggccaccacccagttcaagtaagatagtgagtggcagtaaaattcccggaatcttcattgcctccatgaactgctgtgtccccgcataagcttcacccagcttcccatatcctgcgataatgaacaggactgatattaaaatgcgcgccgtcagcaggccactatcttcaaattttttcatgaacgtctccaagatacagaaggcaatgataataaaatgtctgtttatattttcaatgactaataaatgagctaaaaagcacaatttgttaatcataagttgatgtcaggtattctagggagagatgttatttgttgatagtaaggaatattaacaatttattgcagtttttttgaaggaattacttaacatacgtaaaaggatttgaaagagaatgagaaagagtcgagagctgaaaaatagtattaacgctcgttcaatgtattacacacgtattctatgcaagaaatgaaccttctttatgtccatttaacttattgaaaatatagatttatttaaatattgtcatgctattttatccgttttcccaagtgactcctgtatgcacgaaccccccattcagtcctactgctgcgccttgtcgggtaactagccgcatgatcccaaccccgacagacacgatggtagtagcctcggtaacaggcttgtacaagatacgtgtcgtgagtatgaaataattagtatttttaaggatgcattagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacaccatctagaagaacattttaggtgacagcttctgttcaagcctgttaccacgattgagcagttttactaggactgttcaatcttgagaaaaccactcctataaggatggtttttttcaagactaaagattacaacctcaccaaaaggatcttaatttgtcaaacccatagacaaatcctccccattattagcaatggctatagattccaacgaatcactaaatggtgcgtttattttctatagaacaagccagacaggataattagaacttttttatgaagtcaaaatcacagaagcaacgatcactgatctttcctgtgtttactctcactcaataaatgatcatgataagatgccgtatgaaaaagttgtcctcaattataaatccatttcatggaaccatgtaacagcaggaacttccgcatatagtatatgggaataccgagtttatataaaatattgctaagcatatattttatatatgcttagttacataattttgtatcttttacatatttacttggtgcattccatgataatttataacagactgaataacctaaactcttaaatttatagtccaaataccaagatataggaatgctcaaaattaaaccaaacacactaatcaacaacaggtatttaatattttttggcatccttaaagaaaatccataataaacaggaataatgcaaaaataaagaagaaaaggataagaggaaaaaattgcaaatgttctccatgagaatgtaaaaatttcatctatattaaaaattttcacgatatcttcaaaaataaaaaatgtaacagtagacatcattataagcaaagaaaacgcatgaaaatcaataaccacgaattgaagcgtttatttttaacaccttttaacctcgccagtgaaatttggatagtttctctatctggggtttgaggggaaaatcccaaaaagaaaaaatcatctaagcaaagctagacaaacttgatataaccgccaaacttaatatggtcgcataattcataaacaaataaccctccggtaaacacggggcgattcaatctttctatagaaagggaactaaaattatgaccgtgacgaatcaattgcatgatattacagtggccgttacacgctcaaaaggcgaagattttactatagaacctgcccgtatccgcggccctcgttataatgaaattcttgtccgtatggtcgctacagggctctgtcatacagacctcatcgtgcgcgatcaatattaccctgttccactacccgcagtgctgggtcatgaaggcgctggcattgttgaagaagtcggccctcaggttaagacattaaaagtgggcgatcatgtggttcttacttatggtgcctgtggccattgtcaccattgttttgaggggcatggagcctattgcgacgatttttttgggctgaactttggtggttcggatctttctggtcaaacagcaattgaagacatgcatggccagcctttgcatgatcatttttttgcacaatcgtccttcgctacttatacgattgcaaaggagaataatgcgattaaagtgcctaagacagcaccacttgcaatgctggggccgcttggctgtggtattcaaaccggtgcgggtgcggtcatgaattcgctgaaagtcacaccgggcagtagttttgtcagctttggtgcgggtgcagtagggttaagtgctgttatggccgcacgagtagttggtgcaaccaagatcatcgcggttgatgttgtcacttcacgcctcgaactggccaaaaaacttggagcaacccatacggtcaatagtaaagaacaagatgttgttgccgcgattattgagatcactggtagcgggacagattttgcgcttgaatcaacgggacggacggatgttcttggtcaggcgattgaaactcttgccagccttggtattattggtgttgttggcgcacctaaacttggcacaaaggctgaatttgacgtgaataatctgcttttaaaagggcgcagtattcgcggcatcgtggaaggcgatagcatcccgcagatatttgtcccgcagcttattgaactttaccagcagggacgttttccatttgacgaactgattaagttttatccgctagataagatcaatgaagcggcgaaagacagcgaaatgggaaaaactttgaagccagttcttctgatctctgagattgataccttatgataaaatactctacaaacaacgctacaaaatagagaacatgtttgcaaaaatcaaagactggaagcgcatcgcgacccggtatgaccgatgtgctcacacttttatgtctgctactcgtaatcttctggcttaattaatgaggcctgaccccatgtaaatggctattaatagccccgttggttctcaaacccctacttgagagaaactatccaaatactacatcggcatataaccttgtcgttgctggctcatgcgtaagttgttcccacctatgtctattaccccctaataaatcccaagaggctaaccatacggcgtgaccagcgataaaacttcatgggatggcatatgccatagatcagtgcgatacccgagccaatggcgacataaggcttgaaggcaagcagggtctgccagcctctgtcataagcctgaatgatatcaagccagtgttgggtacactctgaaagtgattgccgttgctgctgtatttccagtaataactgttgttttcgccattctcgctgctgtcgctgtgacttattcatgatggtcatcctccagcattttgcgatctatttttagctgttcacgggttgaattgaaaaaagtcagctttctggttttcctgatcgtccatattgcactaaacacggcgagaatcagcagaattcctgcggtaatggccattgccgttgcccgataaacaggatcgatgacccagaatatcaatattaacaggcacatcaggccaaaggtcgcaaataatagcgtgaacccaatcagcagcagcaactgcaccagcgtggccgtattttcttccaactcaacggctatgagtcggatacgggtttcaaccatgccaacaacaatcgctgccactcgctgtaaagtatcaaatatccctttgccagggccttgtgaacggggtggttgggtcatctcagcgttttgccagtaaaatacccaacacggcaccaactgccgcaccgattcctatacttgtccacggattatcacggacgtaattatctgtacggcctgcaatttcttttgtttgatcgaccaacttatcgctgacgtcactgagtgtgactcgcgcatctttcaacgttttttctgctttactgcgtagtttttccaattcagccttggatttgtcactggaactattgagaacttcttccagcgtatccgcaagggattgcaattcagtacgtaaatcttcagagtttttcttctgcggcatattatgctcctgaaatgtacgatggatgaatttctaacatagtcgcttttataaagagtttaaagtacggatgtcaaaaatcatcctgctcttcctgatattaatcttaaattctgtttgacggctagctattggataaaggaataggaaggtcagttgagaaggaaatttgccggaggttcaataccctgtggtatgttttggctcgataccacagggaaaagccagcctttgtattggcaggagaaaaattttcacgacaggatattactgagggggatggttagcgcgtttcttacgccagatgaccgtcaggctgccaattaagccaatgagtagcaaacccagtggtaacagaacgagaaaattcatcacatattcttcgtattgacggaaaagcggacttttgccaagagcataacctaaagtagttaatatgatgacccacaggaacccacttaaccaattgaaaatctggaaacgtccgtttttcagcccggcaattcctgccagtgttggcagcagggttctgacaaaggcaaggaaacgaccgatcagcagtgcggataaaccgtggcggtggaacagattgtgtgcgcgttggtaatagtgagtgggaagatgtgacagccagccttgaaccaacttggtattaccaagccaccgtccctgaagataacccacccagcaaccaaggcttgctccggcggtgagaatgaatatcgtcgcggggaagctcatggcatcttttgcgatcaaaacgccaactaatatcaacaggctatcgcccggtaaaaaagccgcaggcaatatcccattttccagaaacaggatcgtaaatagcaggatgtagattgcccatacgaatgatgggttagccagtgtttcataatcttggtgccaaagtgcataaatcaggtctgttacaatttccatcaaatgttcctaaaacgcggattaaggattacatcttacttttatggtgcatttctggtgcatttctgttgggtactttgaaaatacaaaatattaagtaccgattgtcataaaatacccttgagcttcttgcaagatggcataagaactaacagggacactctaacaaaatcagcagtagcgaaacaggaaattttggtgaccaattgaacattcattcaaatgtaaaagtaaattcttcgacatatatcaattgattaattattgggtgaagttttcccaaaacagcatgatttaactatttatcatgtggactgcttgaatttatgttttttatcagccaaacagaccttgtcgtgtcatttgatgacgaaaagtaacccattaataatattggagacagtacagattctcatcgttgttgttaaaatgatgattcaatataatttattgaataaaaagagtaattactgtttttttattatgcttcacaccacaccgttgtagggttgtaatcagaatattgccattccgatcacacaaatgtaagcaatttgttatcaaacattgtgttgtctgtatatttcaattaattattcgttttagtttttttcatttccctattccggggaagcaaacacaaaaacaacaggctcattgagccaaaaaatatcaaatgggtaggctatggaaaaacaacaaaaaggctttgtgcagtatattgtacagggaagtcttgtcactcaaattattattggattaattgcagggatattattggcatggctgttaccttctgcggctcagtcggctgatttgcttggctctctcttcgtgagtgctctgaaggctgttgcccctgtgttggtgtggatattggtgatgtcctcgattgcaaaccataaaaaaggacaaaaaaccagtattcgcccgatcttgctcctttacctgattggaacattcggtgccgcggtcgtggcggttatcggcagtacgttgtttccgtcaacgctgatactggtgactaatgatgccaaaatttcaccgccagacaatatcgttgaagtcatgagggggattttgcttaacgttgttgttaatccgattgatgcaatattaaaaggcaattatgttggcattctggcatggtcaattggtttaggtattgctttacgtcatgccaaggaatcgaccaaatctttgatgcaggatctggctgaagccgtcacacagattgtgcgtgttgttattcgtctggcacccatcgggatcttcggtctggtggcttcaactattgctacaaccggcttcgaagcactgcttggctatgctcgactgctggccgttctgcttggctgtatgattatcgttgccttagtggtcaatccgctgattgtttactggacaatccgccgcaacccttatccgttggtttttgcctgcctgcgtgaaagtggtgtgacagcattctttacccgcagttctgcggctaacattcccgtcaatatggcaatgtgtcgccgcatgaatctgaatgaggatacctattcagtttctatcccattgggggcaaccatcaatatggcgggtgcagcggtgacgattacggtgctgacgctggcggcagtcaatacactggatatgacggttggcctgccaactgcgattttgctgagtgtggttgctgtgattggtgcgtgtggatcatcgggagtggcgggtggctctttgctgttgatcccactggcgtgcagcatattcggtatttccaatgaaatcgccatgcaagttgttgcggtcggtttcattatcggtgtgttgcaggattctgctgaaactggcctgaattcttccactgacgtgttgtttaccgctgcggcttgtcaggcagaagatgcccgccttaatgcggatcagttatcccagcgtcgttaatgattgactgaaataaaaacggtgataatcagcggatagctttttatcaccgtttctacatttaaggtctaaaacttgcgcagttaaatcttaaacgccaatctggctccctgatcaattgctctgcgggcatccagctctaccgcgacgtcggcaccgccaatcacatgcacatttttccccatcgtttgcagtggttgataaagatctttcaatggctcctgccctgcgcagataatcacattgtccacttcgagacattgttgttcaccgttgcgactgatatgcagcccctgatcatcaatcttcaggtactgtacgctgttcagcatcgtgatgccccgcatcaacaggctggcgcggtgaacccacccggttgtttttcccagaccttcgccgactttcgaatccttacgttgcagcagataaatttttcgtggggagcgttccatttgtgcgccttctggctgtaatccaccacgatgggaaagtgtttgatcgatgccccactcttggctaaacgcgtggctactcaggctgctgctttgtccattgtggctcaggtactctgccgtatcgaagccaataccccctgcaccgataatggcgacacgtggccctacattgcgtttatgtttcagtacatcaaggtaagtcagcactttttcatggttgatgccatcaatatctggcgtccgtgggatgatgcccgtggcaatgatgatctcatcaaacgacgcaagctgactggctgttgcggtatggttgagctttacctcaacaccgttcaatgccaattggcgatcaaaatagcgcagcgtttcgtagaattcttctttgccggggatctgtttggcgatattaaattgcccaccaatcttattgtcacgttcaaatagcgtgacatgatgcccttggctggcagcagtgacagcaaaggacaaccccgcagggccggcgccaatcactgcgatggttttaggcgctttcactggctctgcaatgaattcagtttcatggcaggcgcgtggattgaccagacacgacgtcaacttcccgacaaatattctgtccaggcaggcttggttgcagccaatacacgtgttgatttcgtcagcgcggttttgctcggcttttaaaacaaattcagcgtcagcgaggaaagggcgcgccatggaaaccatatcggcacagccttcactcagtgtctgttcagctacatggggatcattgatacgattggtggtaatcaaaggaatgctgacttttcccatcaatttttgagttacccaactaaagccggctctcggcaccattgttgcgatggttggaatgcgcgcttcatgccagccgatgccggtattgatgatggaagcgccagctttttcaatttccttcgccagttgttcgatctcttgccagtcagagccttcttccactaaatccagcatggagagacgatagataataataaagtgctctcctgtgatggcgcgggcagctttaacaatttccacggcaaaacgcatacgattttcgaagtttcccccccacttatcctgtcggtgattagtgcgggcgaccagaaactgattgatgagatagccctctgaacccatgatttcgacaccatcatatccggcctgttgggcgagttgggcgcaacgtgcgaaatccctgatcgtctgctggatatcttcctcagacatttcacggggcttaaaaggattaattggtgcttgaatggcagaaggagcgacaagatttttctggtagctgtaacgtccggtatgcaggatttgcagggctatcttcccgcccgcctgatgtacggcatccgtgatgacttgatgatgaggcagggtatcttcattattcagaatacttgcaccggctgtaacaactccctgttcgtttggggcgatgccgccggttacaatcaatgctacaccgccagccgcccgttctgcatagaactgtgccagtcgtcgggcaccatcgggatgttcttcaagccctgtatgcattgaccccatcaaaacacgatttttcagggtggtaaagcccaaatccaacggggccagcaggtgagggtaattgctcattgcattctccaacaaatatttggtgacttaaaagtattattgttttcagtatgactaagtggtcggatgagattgggatcaaatttagacggttccagcctgattggaaccattttgttaagcgattgtgacaagtatcaagaaatgatgtgccagtggaaaccgttcttcaaattctggaatttaacgtgagtgtatttgagaatagttcagcgtttcttttatgccgatgatatttgaatctttcatggagtatgcgtttgaacaacttagcggtgttgccgtggaatttcgtacccattttctgaatcaccagagccgcagagctatcgagcgtctgggggcaaaacgggatggtattctgcgcagtcacttgcgtgcaagggatggctcaataagagacacttgtgtatacagcatgcttgccagcgagtggcctgccattaaaattcatcttttatggctaatggcaaagccacgctaaacacgcgatcaagtatcccttcttgatgataattaatcagtaagggctactttgatatggttatcaagctcgtccagtagttggtaacggcggcgatattcggcgcgtttcttgctggcgatctcttccagggatttcctttctatggctgatggcagatggaaatcattattttccttcctgataccattcagggattcccagaaggcgttataatcggccaccatcttatctttctttttatgccaatagcggatactgcgataaatatgtgtctcgttgctgaccgccaagatctgctcacaatttgcatgagaggcaaaacggcagatagcttcaatcaacaaacgcttaggaaataatccataacattctttggtggcatggcggataatatccagagaattatccattttagccgggccttgcaatacaccaatgaataatgtttgcttacccttaatcgtcaataaagtgaatgcgcatttcgccagaacgacattttctgctgtggtaatatataacgaaagctcaccttctttattcagattatccaatgaatcaatatatatcatgaatgattcatttttaccctgaaccgttgccagcaaataagcatgagtatcaaatattttgttgataatagccggctctaattgttcaaataatatctggtaatgttcattaagtgcacaaacaatctgtttacgcttgaaattgatgctcaaatatgggcgatgcaatttgcagggcaaactgggttgcttttttaaaatatcattataaagcggggtcttagcaattttattcaaaagcttaagtgtagaaataggcgtaaaaatgctgcgcagagcgaatttagttcgataactggaagaatgccagtattcaccgggggtaacacgctttccgacaagatcagcaaacagcttcatacctgaagaagcaggttgttgtagataattcattaggattaaactcaataactaaaaactttaccgagtatatcattgattcattcaatggtattaaaacgtttataaatcatttaatttctttaaatttctttatttaatgttttttatgcaggtattcgttgattagtcttattatttagtgttattaaagaggaatttattagtattaatggttaatataaataagattgcattaatatattcatagtaattatgaattatttattttatattttttataaataagatgtaattgttaatatatttaagtaaaattgtaatttgttatcctggatagcccagtttgctgtttaacattctgggctatcaatgaatggcttattcttgtttgtctaaaatggaaatgaatatcggctgaatttacgcgagtttcatgtgcaatagtggaaatggattcccttgcccatcgacttctgagcgagcaaaaacctgaaaccccatatgcttatagaagccaacaccttgttcattctgttcgttcacatccagttcgttgatctgcaattcagtcattgcaaacgccagcagcatcttgccgatccctttacctcgtgcctgtggtgaaataaatagcatttctactcgctgttgatcgactgccacaaatccttcgatgatatgttggtcatttacagccttatagatgattaaattgggtaagtaatcattcaagataaggggacgtagctcttcaattatagtttcaggcagaaaatcatgggtagcacgcacagaggcttcccaaatctggataagaatcgcgaaatccgtttcggtggcttgctttatatacatcaattatctccgcatatttcacagttattcgatgtcagattgtgtgttttcacggctatcctagaattaaaaatgattcagtacaatcgatttaacagaaagtaataggaacccatgtgtaaaaaaaacgccgcagagtgcggcgctatcattatgacttggtttagccactaggctgcgtcccttaattagataaccgcctgtaaaagagtcgaatacagcctaatttcaccctggacaaatagtttcgagcggttttttcgtaacgggttgcgatacgccgatttcctttaagaaaaccgaaacaacgttcgacaacattacggtcacgataagcctgctcatcaaattgtgtgcgaccatcagtactgcctttttcattgattttatacggaataatgctctttatccgcaacttacgcagataaccgcggagttttccgcccgaatagcctttatctgccagcaccgctttgccgcgccgtttcatgaaaccatttttgcgctgtataccaatgccgtcgagcaaagggatggcggatcgactttcgtgggcttgccccgccgtcaaaagcaggttgaggggaaaaccccgtctgtcggttgccagatggattttggtgccataaccaccgcgtgagcgacccagcgcatgatcgtcagcgatatcgggaggttttttttcgcgcctgcggcatctttactcgcgcgaatattgctgccatccaggcaaatttcagcccagtcaatcaagcctttttcatccagaatggacagtaaccggttaaatatcttgttgataatgcccgattttgacccgcggttaaatcggttatagaccgttttccaaggaccatagcgttcaggtaaatcacgccacggtgccccagagcacaagacccagaacatcccattcatcactcggcggtgttcaacatgtggacgtcctgcccgctctgaatggaccggaggtaaacaaggttctatcactatccatgcgtcatcaggaatgtcgtagcgtgccatcatctttttcccgtattgaaaacaagttagatgataatactatcaatttacattaagggacacagcctagtttgccaagatatggtctttacggcgcaggctcgccagtagcatataaatagccgcggccagtaagacaatgaaaaagaaattcattaatccattgtgttgcaacataaaattccctgcgctcagggggccaatggcggagccgatactgtaacttaacagcatcacttgagttgtagccacaatacaagatgaatccagtttatcgcaggcaagcgtgatggcgatcggatagagtgcaaaagaggacatccccagaagccccaaggccacgatcatcacaatataattttcagaaaggtaggtcattcccatcgcaaatacaccgagtagtgaaaccattgccagtaacaacgttttgctcattatgacagacagtttactgacaatgggctgaatcaccattccgcctaaaatagtcgcggccattaatacgccgacttgttcaccatcgaagtggctttggcttaatgataaaggcatcaggccgtaaatcgtacccatgacaacccctgacgtgatacaaccgactatcgctggcttgctgaattggacaatttttttcagcgataagctctgatgatgaagagcgggaggttgcccttgacttataagtaatggcggcaaggtggccaacaatagcagagccagcaccaccatgaaaggcactataccctgagtccctataaagccaatagccagttgacccagtgttgtaccgccataaagtgaagtcatgtaaaaactcagccgcttggctctctctttggggctatcacccatcaacaaccaagactctaccacgacaaaaatccctgcaacggcgatccccgccacgcagcgaataaccaaccagctctctttattcggaaaaaaaggcaagactacaaccgtcgcggctaaaagcagcaaaaaactaataaatgaaaagcggtggcctattttggcaataacaggttcaatcataattgagcctattaataaacccacgtaataagcactggccaaccagctggcataactcgtatcgatgctgaaacttgccatcgataaaggaattaaactcattaagtaaccagaagcaatcgcaaataccgtcaagcctgcgacaggtacaaatgcactgtcattgttgcgcagcagtttcactactgtcgtctccacataaaaaaatcagctggatatgcgctgcttctcatcaagattttgctgaatggcggtaacgatatatgccagggattgggatatatcttggtgatttaagcagtaggtaagtcgctcaaggaccttgagcgctgcggactatagccctttactcctgagagatacaatgagaaaaactgatactcatgaatgaaaagattcatgaaagagtgtaggaaatcaccaatcaatgttgggctaagcgaatacgaattttttaagcgggaatacaaacgtatatttaatggctttagcctacaactaaagccattaataaacattaaggccagcgtcggaacacaatcgaggtattaatcccaccgaaggcaaagttattgctttggataaattctgtctggatctcacgggattggtgcatgatgtaatctaattcgccacaggcgggatcgatttcattgagattgatggttggcgcgaaccagccttcattcatcatctcaaggctcaaccaggcttccagtgccccacaagcgcccaatgtatggccgaaatagcttttcagtgaagaaataggcgtattgcggccgaaaacattggcagtcgcctgactttccgcaacatcaccccgatcggttgctgtaccatgtgcgctgatgtagccgatatctgacgactgccgcccagccgatttcagggccatttccatacatagctgcatggtttccgatttcggttgcgtaatgtgggaagcatcgcagttggtagcaaaaccgataatttcaccgtaaatttttgccccgcgcgctttggcatgttccagttcttccaggatcaatgttcctgcgccttcaccaatcaccagaccatcacggtgagtatcaaacggcgatggggttgttttgggggcatcatttttctggctggtggcaaacagcgtatcaaatacagccgcttcagatggacacaactcttctgctcctccggccaccatcacggtctggtagccatgacggatggcttcccatgcataaccaatggcctgactaccagacgtacaggcacttgaggttgggatcaccctgccgcgcagcccgaagaacagccccgtattgacggctgtcgtgtgtggcatcatttggacataggttgtgcccgtgatgttgtgcgtatgcttttcagtcagcatagtggcaaattcgctgacgggcttggtactgcccgtggaggaaccataggcaatgccggtttcaccatgggtcaatatcggattatccaacaggccagccctctcaagagccgattcagtggcacgtgttgacataagtgacactcgccccatagagcggatgcgcttgcgggtatagtgatctggcaatgaaaaatcggtgacaggcgcgccgagcagcgtattcaggccatcatactcagaccacgctgacatgtgctgaaccgcgtttttccccgctttcaggccggaagacacggattgccagttgtgccccaaagccgtaattccgcccatgccggtaatgactaccctgcgtgtcatagcatacctccgttgactgagattacctgacgggtgacatagcttgctatgtctgacattagatagctggcaaggccggcaacttcgtcaacgtgtcccatacgtttcatcgggattatgttcatggcttctttcagcgcgggttcttccatttggatcatgtccgtgtcaatcagacccggagcaatgcagtttacggtgatttttcgttttgccagttcaatggcaagcgctttggtggcaccgataatccccgccttggctgcactgtaattgacttgtccacggtttcccatcaagccggaaacggaagacaatgtgatgatacgccccccttgacgcagaccaatcattggcattacgcaaggatgaataacattgtagaaaccatccagattggtatggataacactatcccaatcactgccttccaaggcagggaacgcaccatctttggcaattcccgcattacagatgatgccgtagtaagcaccgtgcatttcgatatcttgctccagcaattcgcggctggtggtgcgatctgaaatatcaaaacccaaggtgcggccattgcccccatttgcctgaatctgttccagtgtttttgctgcacctgcggcatcacggtgataatgaacgacgacagtaaacccgtctgatgccagcttacaggcaatcgccctgccgatccccttgctggcaccggtcactagaactgaacgcattatgctactccatcctgttgaaataattttttaagttctgtttggtcaggttgataggtgttcaggcgtcctgtcgccagaatttcaccattaccactgatgtcaccttcaaaactgccgaatttttcatcttgcagtaataaattcatgtgaatgtccaacacttgaccattcgcgaaaaagggcgtcaggcaacgtatagcacggccacccagcaacatgcccaaagctgagtcttcttctttctttgcatggcgatgccagccagaccagacgccgatagtttgtgccatgatttcaatggcaaaccatcccggcagatgaccttctgcattgagaaagggtgacaggacgctgtttttgctgacggtgacctgacaatgaacactgtcgctggaaacgctgataacattttccagcaatatcatgggcgcttcgtgaggaatgtaacgatcgaccgataaatagtcagacattatgcggctcccagtatcaggctggtattgtttccgccaaaggcgaaggaattggacatcacgatgggttttgccaatgcttgtggctgactcaacaggccgcaggctggcagtgatttatctctctctgagcgggaaaaatcctgtgctggcagaggtaactcacgagtcagcaagatccagcaaagcgccgcttcacaggcacccgcggctcccaaagtatgaccggttagatgtttggtcgagctgcatggcgtgttttcaccgaaaagctggttaatcaccagtgattccatctggtcgttcaatgttgttcctgtgccatgcaggttgatgtaaccgatgtcctgcggggatagtttggcattattcaatgccatgttgatggcatcaatggctcctttcccttcgggatgtggtgcggacatatgccatgcatcactggattctcccacaccgagcagggcaacgggctgaggcgctttggtcaacaacagcagcgttgaggcttctccgatggtaatgccctgacggttttcacaaaatggcgcacactgggtacgggaaagtgattcgaggctattgaagccattgattggcatacggctgagtgtgtcggcgccccccacaatggcaacatctaccaagcccatttcaatcagtcgctgaccactgataatggcgcgagagctggatgaacaggccgtagaaatggtgaaagcagggccttcaatattaaggtagctggcaaggaaacgggaaggatcacccagttcctgctggtaatagtgataatttgcatcaggcagttgtttgattccacggctgacgtgcttgtcaccttcatcaaggccagacgtactcgttcccatgataacggcaatgcgatcccgcccgtggaaagcaatggccgtctctacctgaggttttatctgcatcagggccgccagcagtaactgattgttgcggctattgtgcatgaacaacggttcaggaatgatcggcaattcgacttcctcaatcccgcccagaaagcagctttcatcgggttgcaaccagtccgaccgcgcatacatcccgggcgattttccgagcaccagattctgggcaatgtcgtctgcattattacccaaggcattgagcatacccacggcagcaatataaatcatgttttactcttccagatgctgaatggcgatttcataaccaaaaataaattgttggacacggatcgggcgtcgttgctcgttttgagtatcgtaatgaatttctgtgatcacttgcccgtggttatccttcaactggcggcgattgacggtatcgcttagtgtccagccagtaggcagtttcggttgccaagacgaaatcggccagtaactgagcatgatatcggctaaaacctgattcgcgggtgggatctccggtacaacgatggattgctcggcgtgaatgccattacggtcgtaatccagcttaaacaggcggatacccagtgaggataatccggccagagagagtttttgttcatcggcattgagcagcacaatcaacgactgcgctttccctttcactgttgcggtcagcaactgttgttcatgaatggcaggcgtgatagccggcgcgggcagagacacacggactcccggtttcaaccatgcactgggcgagccgttctgggggaagttagagcaggctgccagcagacaaactagtgacaggatgaataaccgaatcatgattttttattccttttttgccgttcaggcatcgccaacggtgacagcagaaaggccgtgaatatcccgctgcataacacaatgccaaagctactgattgcctgagtgctgctgaataccagcatgcccagtgtgagtagcgaagtgcacatagctacgctaatggctaatagtgaagtcagtggtgtgccacgaggattgctgaaaaacagcgtatagttgataccaatgccaagtactagtaccaacgcgaggatggagaagaggttaatgctatgaccactgaagccaagggtagccagcccacatccgagagacagcaatgacggcaacacactgatcaggccacgtcgcaggccaagccgcatgatataacttaccgtgataatgatcactgaacctgccagcagccagccaagcatggtgcgataaaactgaaacatctcatcgaatgccagtttacggtctacccaactgacaccgttctgttgttcagccaattgacgcatccgcacactgtccttaacgccattcacaggcagcaataccccactttggccgtctggcagcgttgtccacatcagacgccagccttcgctaatgatactgttttgccattcgtcaggggtgacggtcatcggatggaggtcgggttgtttcgccggcaggcctgtatctgtcaggcgtgccatgatattgggcgtggctgtttggataagcgccagatcccgttgttgctgtgcaagggaagacaatggcaggcgctggtaattcttgaacgtgccatgctgtttttcggcatccagtttgggaatgaatgattcgaggcgctgtaatgtttgttctgcactctcgccgtagatcacgaaccatttttgatcacttctctgtctggtcagttctgcgatacgtttttcctgttgatgaatatcctgtggtagcgcctgtaactgagcaatgtcatcattcacctgtaagcgggaaattcccagcagggcgaaaagtgccagaaaaacaggtaatccgatgtaaaacaggcgttggcgtcgccacaatgccagccagcgcataagtgtgatcatggcggggatcgggcgtactggcagatttttggtcagtctgggataccagcagacaacggtcaggcaagaggcggttaaacccgcggcagcgaacacggccagttggcgtaaaccggggaaaggggcgaacatcatgatcaggtaagcaatgaccgccgttgccagtgccatcagtaaagcaggcaagactttctgcatactttgccacggcgttgtttcctgtccatgaaccatccgctcggtcaggtaataaatcgcatagtcagcagaaatgccgataatgctgatactcatcaccagcgtcataaaatgcagttcaccgaatatggccaatgtcagcacggttccggccaaagcgcctatgctgacggacagaacgcacagcagcaacggtttcagagagcggaaaacgccataaatcaacaacagtacgccgagtacagtcgcactgcctagcgttgaaatgtcatgcttcgcctgctggctagcataatcgctgtaaaacagcgttccccgtgaaataacttcggcatcagggaaaacgttctttagggattgctgcaactcagccagttcaatcactgcatcatgcccctgctgcatatcgaaagaggagcttttgagttctccatgcagcagataccagtttcttcccgtttcatctttggcgaccagccagccgttttggagtcgcagccggctggaggtttgctggagtgccaattgtgagcctctcaccagcatcaagggatcattgtttagctcttgcccactgacgcctgaaaatgcggaatagacttgagacaatatccagtcagcctgacggttgccgttttcttgcagcctgtcacgcgtagcaggatcaagcatggcattgcgatgctcatagtaaaaacgcccccatgcctgttgttggtcttgagccattggtcctttgaccgccgccagaaaaggcgctttttgtaactgttccagccagaattgagccggagctgcatcctctttttgtcccgggctgaccatccataccaattggcgatcgaggcgttgcataaactcatctttcaatgcgggtggcatatctcccgcactttgtgccggtaataatgccagtacactggtcgatagccttgattgcggcaagagcacgaccagcgacaccagcaggataccgcatatcagcaaccagaatatcggtagtaggcgtggttcagaatttgaagtgttgttcttcgtcatgactcagtgtcttcggcgtcagtcggtgttgggtaaaaaacagttcggtgcgatcgccttggcgatcagtcagcagaatggaatccagatttgcctgaccttgcagcgtaatggtggtaaacagtttgtccaacggcgaggttttgggggtcagtatcaattgccatttttcctgtcccagatctttgaagtcagttttaaagttttcttcaagcacagcacggtcagcttgaaacagtgctcgcatcaagtgattaaactgaaacatctgtggattggattcagcggtgatgacttgtggtgcttgccccggcataacctgcaccattcggctatcgtccagcagcatcgtcagaggaaacggtttttgctggtgccaccatagccctttatgtggtgaaaccagcatttcaccactggagtgcagaggttgaggcatgccgtcaatctggcgctcttgcgtgaatttagctcgaaccacaggttggtttgcaaaacgttgttgcaactcgtcaagggtggtggcctgtgccacgttatgggctaaattgaataaattggctgccagcaatagcagtattgacccgcgttttttcaaggtctgactcccatgcgttcaaataagatatctgggctgacaaaacccattttctgggtattttcctctaccgccacttgaatggtgtaaccggttgtggttttcctgccgcttactgcatcaaaaatgtgatacgcaattttcaggcggttctcaaattcctcaatagtcgctctgacccgaattttctgttcaaattgcagagactctcgatatttaacgcgggtgtctacgattggccagacataacctgattcacgcatctggcgatagccgtaattgaattggttcagtagtgcttcacgagcaatttcaaaatagcggaaataattgccgtgccatacgacccccatgggatcagaatcatggaatggcacggttaattcgacttcagcggtaaaacggggatctgttagcatttttattccttacccttcatatcggcgggcagttgccaaaaatcaaaaaaattaaaccaatccagtggagattgcagggcgtaatgttccaggcgggaggcatagtgatccactgcctgctgtaatgcctgctctctttggttacggggaagtttcagcggatcggcgaaaggttcgcaatgaatttttagctgactgttttcgaactgatcgttttggcgaagggcaaacatgagcagcaccgggcagcgcaaaaccgatgcaaggataaatggcccttgtggaaaaggggccggatgcccaagaaactggctccataccacacgcggtgtatgggtacgggagggattgatggcaacgcgatcaccgacaatcgccacccattcacccgcatcaattttctctttcagcataatagcggtatctgccccgacatcggtgacaggcaataaattaatgcctgcctgaggggaaacttcttcaataatctgcttaaaacgctgggcatgttcagtaaacaccagcgcattaatggtttgcttgccagcatgttgtgctaaggcgcggcagacttcaatatctcccagatgtgaaaccaaaagcagtttaccgtccgtgttcccattcaggagtaccgcttctgaaccttcggcaaattcgacatctttgccccatttcaaatcgccacgccaacttgcaatcttatccagcatggcgacaccaaaacgcaggtagtggcgataactgttaaggccgtggggaagggggatcttctggtgatgtaaggtctgtttcagccgttcaagatactgtcttgatgcctgacgctgcgcgccacctgtcgcccagaaataaccgacgacgggatagagtagccactcaaaggggcgtcgtcccagaagccggtacacggccagcatgaacttcatgccatgcagccccttacgttcctgaatgtccgaccaatggcggcggttacgccataacaaggaaggaatgcgcggtaacatgccaaaaaatagccgggtatgcatccaagaaatgctgaggttatcgcgcaaggcatcgaagtgggacagaccatttgcgggataggtgactttggtcggcacaaattcactttccgtcccttgccagtagagccgaaccatgatttcgatatcaaaatccatccggcggccaatctctttttgggacaataattgcagcgtgggggctaagggataaacacgaaagccacacatgctgtcttttattgagaaagaaagggtttccacccagacccagaaatgggtcatgtagcgcccgtaaagccgggattttggcacagaggcatcatacatcgggctgccggaaatcaggctggctggatgctgctgggctttatccagaaacttggggatatcttcgatgcaatgttgcccatcggcatcaagctgtaaggcatggctatatcctgcatttgctgcggcctttagacctgccatcaccgcgccgcccttgccctgattgcgctcaaggcggattagggtcacatctggtgtcgtttttactaatgcttcaagactgtgccgggtgtcggcggcactgccatcatccacaataaaacagtggagcttgaaaggggcaagccttgccagcacggtgggcattgtgctgccgtggttataacagggaatgatcacgcatggcgtaatggcgtgtgcatttaacgacatagcttgattttcccttggctggctggatgaagttcaccgctgttcggattttccacgccataatggaagatcagaaggtttttttcttcagtccatatcatgttcaattgcagtcgattccccggttgcaggggcagttggaatttcaccatctcaatcgaagaaaaagaccaacccggagccagcagggtttgggcataatgcataacccaatcgatttgagcgacgcccggcaagatcggctgaataggaaaatgcccacggaaccaatccagggccggatctaaatagaggtgtacaatggcctcattcggagcgggttgctcacggtaaatttcaacgggcttcattaaatagctcctgtaatgcaggccatgagcgcttgctttgggcattcaggggaatggttttaaccacccgccagtaacggggtaatgcaaccggctccagccaaagttttaattgtctgcgccaatatcgggaaaaccgtgtgatcccctgttgctggtaatgggcataggtttcatcatccaaaactacaactgccccaatgtgacaacgtttaccgcgtttgacggtcaatacggcggtatccgcgatcccatccatttcacgtaatcgacgctcaatgtcggatagggaaatgcgtttttcaccgatttttactgttcggtcccgacgccccattaaggtgaaattaccttgggcatcaaaggagagccgatcatccaacgccatgccatcaggatcagagagcaggggagaatagacacgcattcccatctcatcctctttttcaaaggaaacgccagaaaatgtcgtccaaacggtatcatccgttttgcgtgcgcgccaagccataatccccgtttcggtacagccgtaaatttcatggggagtaatgttcaaccactgcatgacctgctctgcatccgaaaaatgcaaagggcctcctgctgaaacgacaaaagagcaatctggggcagggagattttgatccaattgctgaagaaatgccgggctactgatcaaggcacagcgtggattgttggtcagttgttcaggaaattccaccatcgtgcgctcaaatggcaggccaagtgacatggggagccagatgcggaaagtcagcccatataaatgctggtggctgaccgaggctctgatgagacaggattgcagtatttttccccacagggaagccagccattgagtttcttgatccatgactgacacggatttgattatctgtttgggaacacctgttgagccagaagtaaacagtactaaaaccgcatcgggcgcgattccgggcagtacggtttcaggtaaatcaatcttcccttcattcgggaatagctgccagcaagggcatgataaggtcaggggcaaatcagtcaatacaccatcaaacagcgattgttgctcttgtagctgtgcctcacggcaatgccccgggatcacggggatcttgccagcatgcagtgttgccagcaggccgacacaaaaatggtagctgtcttcaaaacacagtgcccagcgggtcgctgtgttttctgccatacgcaggtagagtgccatgacatcatgacggagagtgcgcagagtaatgctgtcgttgccttgccagctgatagggctatcagggcaatcatccctcgatagccattgcgatatggcgtgtgttttcatcgttttttcacctgttggcgtaccagccattcaatggcgataagcaggccaattaatagataactcaccatgccgttccacaatgcccacagcttcatatcgttgtacaagcaagtacccagcgcgaccgtgccgttgaaaatgaaaaacagacaccagatttgggttactttacgtgtgtaagcaaccccttcaggcggtaaatccgcttctttcagacgcgccatcctttccacaaccggagggccataacgcagtgaactgccgaataaggtgagcaaaacactatttaccaccacagggtaatacatcaacagttggtggctgcgtagaaagaaactggctaatcccaagataattccggcaatggataagatccagccagtatcccatccggttggcgattgattgtgggaagatgcccggatcaacagcaagcgcaggacaaaaaatagaatgatgaccaccagcatggcatgaaactgcccgtagctgatcatcgcccataccagaaaaggccagacgattaatagcacggtattggcgatgcggaacaataaaatcaaacgattcaatgaacgacctcagggcttgctgtttgttttgactatgatgattattgttcgttcagtaattgctcaacggcctcaacaacatcctgtacagtgcgtacggatttgaacgattcaggtttgatttttttacctgttttcttttgcaagtgaacgaccatatcaacggcatcaatgctatcgagttccagatcctcatagagacgggcatcaggcgtgatctgctcaggggagagttcaaacagtttgaccagaagttgtgagacttcttgaaaaatttgttgtttttccatggataattcggctcttatgcttgctgtaactgaatataggctgccagtgtagcgacggaatgaaagtgctggcgtacttcttcactttcagcggataagacgatgccatagcgatttttgatggctaaacccagttccagcgcatcaatggaatccaaccccagaccctccccaaacaggggtgcttcggtttcaatatcggctggagtgatatcttccagattcaaggtatctataatgatttcttttatttcagtttgtaattcttgcattatcgtatccagcagctagtgatttgagggggttaataaatgggtcaactgacgattaagttgacgagcggcgacggcttgcccgctctcagcatcgacagcaaaattttcatgagtgagctgttcaccgacggtgatggtgtaaatgggttttttcggtggaatttgataccacttactttttttatccagcattttctggctgcatatgatatgaacgatccgtaaatcacatccacaccgtacggcaatattagcagcgccacgttggagtgtgatgggatggtcaggaattgtgcgggttccttccggaaaaatcaaaatattatgacccgcagttaaacgttcacggcatatgggcagtaaactctctgcttcgctattaatgaggtaatttgcagaccggatcacaccactgacaaaaggattgcgcaacagcgcagatttcacgatgcaatccacatccggtaaggttgatgccagaaggacataatccagcaatgttgggtgattagcgacaatcaggcagcctttatccgtgcgaattttttcaatgccatcgaaatgataatcgagcacgcctacttttcttgtcagaaaaaaaaacagccgaaaacaggcagaaatgctgtgccgcgccaggcggcagcgtttatcggcattgcgttgaaaaaccagtaacaaattaaaccagatgagcgaaagtaataagccgccgataccaaacaaggcaaaacaaacccctgtcatagtcaggcgccaaacccaattaatgcgttcaatcatgttaattgccgttttctgctccatgtcagcgattccattgccattggcagtgatccccggtaacggtaaatccctgtgtgtgactcaaccaaccgtggagaaactggaggctctggggaagctcgggttcagtattcgatgaaggctgtttttcgcaatgcagacttttcccctgttgcagaagcaaagcaaccgcaaacggataagtgggtgtcttcgcacctatcacatcgtgataaaaactggggagatagccatcaaaatcgacgagcagcactttgccataacccgcatggaacaacgtcagcacttctagcagtccttgttgaaagctatcgacgcctgctgaaatagaagaagagaccaaaggtgctttggcgacaatggttaaattgccaaccgaagaattatgaactgacatggcaaaattggttggagaaacacattcttcctgtgccagattcaccaagatctgataattacgctccaattcaccatgacggctggtatagacgaccgcgtctacttcatttcggcgcagaatactgagaccacaatccacggcaagacggctgccagaactcaggcggcgggctgtcatcatgggtaattgtgtacattttgccaatgaacgtgagccatcaatcgttgcgggtgagccaatagaccaatctttccactcctctggagtagaaagccccggcgcaatagcttgccaatctgtaatatccaatgtcaacttcatgaaataccattcgttactgctttttgcagatcagtaatgtatgcccaagccctaactgatcaatctgactttctactataaatccagctttatggaggaattgagtaaaatcctcaatgctgtaaaaacgactattgccgtttgccagacaggtaaaataaagtgaagtggcattaaggctatacgctgccgcttcaaaaggctgacaatcccagaataattccatgatgcaaacccgggcatctggtttcattgccgctgaaattttgcgtagaatgccaataatctgagtttcagaaaagcagtcaaggaactggctcatccaccagatatccgcctctttggggagttcacaatctgataacatattgacaggatagccggaaatacggtcggccataccttggctgagtatatttttttcagccaattcaatttgctggggtaaatctagaatagtgatgctgactctactgtcatattggcaacaacgcaatgcccattttcctgtatttcccccaacgtcataaatcaatttgggattcagagcgaaaatagtttttaaagccgcattgaaagcggaatcagaataaaaatgatcaaatgagaaccagcttgttttggcaggctctggcaattgactgagtgcagggtaaatcgttggccactcaccaaatactttcaaaccagccggcttatttttttgcagtgattctttcaggtgaaacaggccttggtaacagacgtcttgggtgaagtccatattgacgcgagtcattttgtcatgcaataaatagtgaccaattttgcttaggaaatagcgctcatcgcgcttaagaataattctgccacttaatcccatatccagcaaaatacccacaccatagctatctaattctgaatcgttacagatttcgtctttagttgccccttgtttatgatttttatccaaaaaagataaaataccgaaatcgcgcaggttgacggctgtctgaaacagcataggagcaaaagcaatacgttgagcttcagtaatcgcttcaagtgcactgcattcatctttgtcatagttatggggttgggtcatattccagatatccgatacgtcagtgaaactctaatgaaatagagttaaagcctatcgatcatgagggttaaattcaggggataggctgtaaaataagtgtttattgattagccatagctgccagacgtaattgaatatcgttatctaggctattgatccagcgattgtaattacggtgaatgtttccgtcatgtgctttcaaattctggctactgacatagtggatagtatagtttttatcagtataggtaatgcgtattttaacatcgtggctgcggtttttgagaagaccatcgataatacccggagaaacgtcattcattacccatttacgtttttgccccgcttccaaaatggctttcttcactgtcggcagtgaattttttgtcatgattgttgtttgtggcgttaatatcggggcagtacgagcacagccggcaagcatggcgacacaggccaaactgattaatagcttagatgtcattttcatggattttctctggttagataagtgcataaaacttgttaatgtatgcgtttcgcgcagcctatattaaataaattattaccatactgccacacctactgtttttttcataaaaatgattatgtttaactcggtattcggctcgattttactttcatgatttatgcaatattaatgataaatgttcgattggtagtgctaattggtagatatttttatgtgattttaaaaattggtagggtaaaatttattttacaattttattatctaagtgttaatgaaatgttttttcattcacctctcttattattataaatattacgaatttattggtgtttatatatttatattttttatgattgttgtctttaagtgaattaatgattcggtttgtagattaaggtaaatattgacgaacttgacagcctctgaaggacggagatataaggcgcactggataaatcgtccctcaacatggcgtttttccagcgcattgatatcttgctgttcaatggttttgactggaacatatttttttgttccaggcaaagaaccatcgtccagccagacacaaacctgaaaaacgtttttagcgaggtcaaccccccactactttggcgcagcctacactgggcgaccaagcggccggtgcaatcgcgaggaagcgtttcagttcgcatacgatcgtctctaccgacaagctactcagcggtgcgccgtcgcgtccaagccgtggcataatgtgttgcacaccgtcgtagtgccagcggcaatcttccgtttcggctgactgtaacgcccgcgctaaaatcgatagatcacggcgtggccgtggcgcagcggaatgtaactccacccatccttcatagcgctgatggacgaccacatcgtcctgtgtgacgagcgcgatcgtcgataacggcgtgcggttgtggaaggcaataggcgaaaacccgaagtaacgttgcggtacgcgcacatatggcacatgagaagtaggtagacggaataccgcaagatcaatctcaggatactgctcaatcgtcacgttcggactgtcgagtagcgcttccgtttccatgtgatgctgctcggcgtcacgccaaagtgcatcgcggatcacagaagcatccagcaagtcacgcaatgccggtagcagcgtgcggaaaagtgccgtaatgcgcacactttcgtttggtaccgtacccgcggcgtgcaatgcttgctcagtgattgtgttcagcgcgaatgcgagtcggcgcgctttcgtgctatggccacacgaaaaatcaccgaaccgtgcgacgtcgacgagaagttgtccatgactctgcgcgtgctcaggcgcgatcagtgcgtagacagatgcgagcccgtctagatcaaagtggtcggtcgtcacatgccgcacgtcaggatactctgacatgtcaggcacaaagcgcagtacgctctcagtcgacagattcgctttgtagcgggcgggagtccggttcgctggccagtgcgacagtgtaagttgtgtagctatattatggatcgcgtcggctgctatattcggcacgttgcgcgtctcttcgaacggcaggaacgcgaggcgatcgctgggcgataaccgtactgcttggataggtgatgacgaggccgcaacggtaactttcggcgtgagcacagcaaggcgagcaccgtcagcatcagactcacgcaattcgagttcgccatgacggctgagatcgtaatacagcaccgcgagattttggcgtcgtaggtcgtatggattgtcgtttcgtgtaatggcacctccccccgcaatcaggttttgtagatcgaagaattgattgtcacggatcgcgacaacgcggcttgcgagaagtcggagttcaaacccatcgagcttagcagcaacgtcatcattaacctgcacgaagcaatcaccgtcgtaaagaggaagggaatttatcatcgaatgtctcctatcaattcggatgtcatactgagatggaacagcaaaaatgcggctatcgaccagatgacgatagcgatgtgtgtaagttgcaggccttcttggcgtatccagtagccataccacaatccacctagtaacagcacgaatgcgcacgtagcaaaacaggtaatacccacgttgagccataatagcgtgtccgggtgtgatgcagccgttgtcagtagcaaatagccgccgctccacatgacaatagcggtaagtgcctgcaataccacaatgacagcaagcgcagcgctatgtatcgcccgtgatgttgttgcacgacgcagcaacggagtattcacgggtggttcctgtttgagcagcgtcatgctcatcatgcgacctactgtacccgtcgtcactgtgaatgactgcacattattgatcatgcctattgtcgcccatccggcgatcccgaacgcatgcagagccttaaatagagcgattccggttaccgggtccatgatgagtcctcattaattggttcttgtgggcagacgttcggcgcgtttatgtgaggcgtacacggcgtacgacaaacgtagcgaccaccggagcaattgcaaagactgcaaacagccacatagcggcactctgagcgccagccaaaccgcctgggtcagagaatccggcaagattcgctacgatgcctgcaaatgcagaaccaatggctgtcgcatacagttgcacggtcgtgatcgacgtcgacgcaagatcttcctggccagcaggcgcgtttgtaaacacctgtgtgagcagatgcggccaggcggcaccaataccggcaccaaccgctgcgagcgctatgcacatcaaggtaaggctagaaactgggccgagcaggtgctgcgatggcatgatgatggcgagtacgatgagcgcaagcacaacgagaattgggccacgccgcaccagcgcctgcgcagtctgtgcgctgcgcccggagctgaatagtgagccaaccgtccaacctgccgccatcagtgcagtcgcatagcccgcgattaacggctgataaccgtggatggtctgcagaaaatacggtacgaatatctcgctcgtcataccgattacaagcaggctcatacacgcataaattgcaccaagagacgcgcgtatatcgtaagcgccggtcggcagcagtttaattttcgacttacgatcaacgcgcgcaatcaacacgacgatcacgaggccagctgcgacaccggcgatgtttgcaaaaatctccttcgacaggctggcgatcgatatgataagtaccgatacaccgagcagcagaatcttgccaattgcggcccgttccgtctgtgcactagatttctcataggctggcagctgggcgagtacgatcacagcaagcacggcggcaacaggcaaaagcgcgataaatgcaagacgccaagtgtctgagtgcgcaaagataccgccgattgcagggccgcagagcgttgcgataccccacataccggacaccatcgccatcgcgcggggccacaaccgcccatcgaatacgatacggatgagtgcgtagctgagtgcaaacaggatgccaccgccgaagccctgcacaaatcgtccaacaagcatccacaacatgtcttttgcacttgcgcacacgagtgtccccccacagaacacaatgagagcgacaagataagcagcacgcggtccgaaacggcttagcacgtttttggacaatggcgcgccaataatcgacgcgaccatgaacagtgtggtgttccatgcatagtactcaagcccaccaatgtctcgtacgacggacggtaggattgtcgtcgcgatatagatattgatcgcatgtagcgcgactccccctgcaagcgcgattgaaagcaagccgttgcgtccggaaagcagttccccccaagagggggcattgttagaactcatggactacctcgtctgttgataggttgaataatggtcatcaggcctgcgaaaaatgctgtgagatgagatgcgggttgctctcaagcatttcaatttccggagaatagatctcgattacaagaccgtccggatcttcaaagtagaaagcggtacgcacacgatccggccccgaatgatagccaagagttgggccgttgccctttacgatcttgatatcgccgtccgcccctactattgctgcgattgacttgaccccttcggggtctgtgcgcacgccaaaatggtagccgggtgggtaggtaacagtatctgtttgttcgataaagaaatcgaagccgtttagctccatcacaaccttctttggacctaggttgtagcaataggaagcgcctaagatccgatggtagaaatcgacagatttgtcgagatcctgtgcgaggatgttgatatggttcacacgtagctcgcgcggtcggccatcttcaggtttgtcgcgtaagcgtcgccacatcttgatgcaggcagtaaacgtagcgaagcctgcgagccagtcgcgtgcgacatcggctgacgcgtccacagatttcatctcaagcgagagaggatagcagaacatgctctgaggatattcgtgccataccgcagatgcttcaccgccggtattctccggatcgataccgatctgcgcgacagcaatccgcccaacttcagccagtcgcttgctgtttatcgcagtcggcgcaccacgcgaaagcacaaatatcccatccggcgttgtattgtctgcttctgccatattcaatcggtagccggccgctgtgcattgttcggataacgtacgagtgacctgttccgcgtctgtgggattaatatcaagattaatcagttcgaaggtcagcatagttatacctcactagcagggcgttgaccgatgagaagtgtgtagcggccaattgcgtgttcgctgatagacaagccatttccatgtacagcacgagctatccactgcgtaggatgtagctcgccgtgattggtgttaaccatcatgtggagcgagaagtcagcagatagcgggggcgtgacaagattttcatccattgtcattgtgaggatcaagagtgcaccccctggcttcacaagacaggatgcgtaacggatcactgcaagcgcctctgtttcatcaaagtagtgaaggcaatcgttcaacataacgacgtcggcggctgctttctcaaagttgagagcgtcaagcaggtttttctcacaaaactcgagccgcccattgaggccgtatgcttcaatcgttttctgcgcagcgtcgcgggtcgttggtagatcccatatctggcctgttagctgtggatgacggtgtaacgcctccgcgatgtaggtaccgtgtccacctgcaaggtcgatcgacgtattcgcgttcgcaaagacactgaggccgctcacgacatcacgcatgggctggctcagacgtaccatcgcgtcattaaacgcgtcgcgagcacgctcatcgcgcatgaaacgactttcctgttggaaattgagtggcttttcgctgcgcagaatttctccaagccggggccagttctcccattgcagatgctgatgctcaacaatcgcgcctatgtagtcggaactcgtacttgtcaagtatcgcgtagtcaactcagtgttcaaaaactcgttgccgtccttccttagaagtccgagagcaacaagcgcgtttaacaggattgacaccttaccctcgaccatgccgaaatttttggcaaccttggccgatgtgcagctttcctgcgttaaatcaaatagcttttcggcaacggcatagtgcaggactgccgattgccggtattgatcggacaatttcaccaagtcgatgactgaagtcagtgcaactttatcgtttgtcgactcatagattgtctcagtgactagctcgctcattgaagtccctcgttaaataatatggtttttgggaaaccggtacacctcacactacagtcagaacgcggtcgaatcacaattctgaccatactcaaagcgactccacgagccgaaaacccatcgcgtagatgtcacgctggtagcggccgtgacgacgtgcacagcgtgccagatcaccaaagcgcgtgaagctgccaccacgtgcgatccgatagctaccctgagtgcttgcgaggtcatcgttaatcacatcgccaccagggtagggggagtaatcatcggcgacatattcctcgacattgccggcgagatcgtcgatgccaaacgcgctacgactaagaggaaagataccgacaggcgttgtcgacaaaggcccggcttcgactgtattggctgcgtaaggatcgaactcgttaccccacggatactcggaaccagtgcctccagaagctgcgtactcccattcggcttctctaggcaatcgaaaacgccgacccgtcgcctcgctcagccaatctgcatacgcttctgctgcttccggagggacagaccagacgggatgatttgcccgttcgcccggatagacacctaagaaccaagacgtcggaaaccatggcgctctcgtttgctcaagaaagagccgatattcgagattggtgactggataacgcataatccggaatgccttgatttccacgttgtagcatgggcattccttagctatccattcctcgattacgccgacacgctgccattcggcaacgacctgtggaacctgctccggtgcagtgccgagccaaacgcttgcgccgggtacgtcacacatttctggatcaagcggacggatacgtggatcgcccgaaaagctgagcaatgtacccgctgcgtaacggcgttcaaatgatgtggacggattctgcgcgattgcgatccactctgccggctcaagttgcagtagatcgagatgcattgaaaacactgtcgtgggcatgcgcgcaacgaatagattttcgggcagcgccatcgctgcacggtcactgagatggttagggttgtcggcgagcataggtttcatgggtatggcctcaccttagtaggaaccagattttctaactgtcagaaccaaatagttcagtccggctgttgggcgcggtacacggtgcacactgacaagagtaaaatgcgcgacgcgcagcaactcggtaagctcagaatctgtgaactcgcgataaagccgtcgcattttatttgcgtacagccgacccggctctttcgactcaaacactgatattgtgaagagcccggctgggcgtaaaaggtcgtggatgcgcctgagatactcaatgtatgcatctggatgttggtgatgtaggcagccattgtcgagcacaccatcaaaaaggttctcaccgtctagctcagtcactggcgttatgcggaattgcacctggctaccccagttccgcactagttgtgcccactcgggaagttcgacgaggtcaaccgcggtgacccgatgaccttgtgcgagtaagaacccagtatcacgtccgcgacctgcgccagcgtccaggacatcggaagagcgaccgagatgagcatgcaagatcacacttgcctgctgcattgcagcctcttcggtccaggcgtcgcgcccttcgttataactcgatacaaaatccgagcgtaacacttcttcataatcacgtggtgccgtgcttggaacgtcaacaggaacgattgtccgctgagcatcaatgtaatgtggtttggtgtcactgctcatatgtactccagcgggatgtgatagacattgccgtcatatgaactcgcaagaaacacatgtgtgatcggatcgtagctgagagacgacacgcccgcggtcgtcacccacacattgatcacccagaggttatcgatacggtcgtaaatagcaacacggccgttatagctgccagtcgcgatatagcgaccgttaactcccgcagcaacacatttgatcgaatgcgtgtgaggagtcgcgatgatatccgcctggtgatttggtgaccatattcgcaatttcagatcacggctcaccgacgcaaaatagccgtcattaaggcctgtacagccattcgcgatcttctcgtgtgcacgcttaagcgtgcacacctgctcaagtgtcgacacgcgataccaagctgctgacgcatcagccgcaatggagaaaagcagatcaccagagatggcgacacccttaacggcgttaccatgcagtggcaggtcagcaatgtgcgttacctgcgaaccttcgatacgcagcacaataccttcgcccgtgtacgcaccgatcaccgcatggtcgatgccattgcgcttgaacgatacgccgcagtttagtggggagcgatgctggtacaactcacgacccgtacgcgcatcaaacactttgccgagctgcccacctgtcaggatcacgtcacctacgggcgtgagaaagttgcacagactacccatgcatgcgtgctcacgctggtcgacccgcacgatgcctgcatcaccaatcgtccattgttggccgtcgactgacacggctgcattgacgacgtgtgtcggcgctagctcagtcaaatcccactcatcggttttccagttgtacagacgatagcctgattggaaagtggcgaacacaatgtgatcgtcaccttcgaaggagcatgaacgcggccatacctcaggcggcagtgacgcgctcacgagctcttccaactgtccaaatggccccacttgccatagccgcattgtgcggtcgtatgacagtgacactagaaggctccggttgtggtcgagcacgagacgcttcacacccgcatcatgcgccctgaacgtcacctgcgagccgtcagtaccgattgaaattatctctccttcgtcgttgccagcgaagatgcgtccgtctgctgcgatagcgatagtgtcggtctcgatgccaccgagatcgatgtcagcgacgaggcagtttttctcaagtgaccaacgcttgatcgtaccatcgtcgcttgacgagatcagttcgtcggcattatgcatccatgcaaccgagatgacgtcagctgaatggcctttgaacgtgtgcagcagcttgccactgaaatcgtacacccggacgtgatggtcgcgtgaagcggttgcgaccagaggcttatccggatgaaatacgctcatttctacatcgtcttcatgatcggcgaacacggcgaccaaccgcaggtcgggtacagtccagagccgggcactataatctgatgatgaggtaacggcgtaagcaccatcgggtgagaatacgccctgattcgcaaggtgatcgtgcatcgcacgggcgagcggacgttgggtgttagcatcccacaggatgacctggttatcgtagccagctgttaagacgtacttatcgcggtaggcggcaatcccgctgatcggtgcatgatgggtgatcattggagttcctcgcagaggtttatggtgtgatggtgtttgccgatcttcgtgcgccgatagcgatgattcgtactattgagggacactccggtttgtcgcacatgcctgatccgaatcccgcttctcttgctcagcctgtggttagttcatgaatctatcattccagcaataaatggatcaatggcataagtagactaattatgttatctatgtcgcaaatgttgatatttgaagcttttactttatgaagacgattaatcgtacctctcatgctcttaacgaaatggcggatttcgccaagacacttggacactcacatcgattgaccttggttgaggcaatctttcggcacgaaagctcggtagagcatttggcggagatatccggcctctccatcaccaatacttcacaacatttgcagcaattgcgacgtgcaggattcgtccaaacccgtcgcgaaggcaagcatgtcctgtatcggattggtgacggcccagttgcgaatatactggccgcgttacgagactatcttgcttatcagcaaaccgagatgcagcgtgttgtctccgacagcgtccatcatccggagcacttagaaggtgtctctgttgaagagctgctccgcagacaggaggaaggggtactactactggacgtgcgctcggaagaggattacgccgtaggacacattccgggagccatcaacattccaacagaagcgctcgtacaccatcttggagaactgcctcgcaatcaggatatcctcgcttattgtggtgggcgatattgcgtgctctctattcaggcggtctcattactgcgatctaaaggattcaaagccctacgccttggggatggattcccaggatggcgagcagcaggtttgcgtgtggaggtttctccaataggttgaagaagctccggtgaaggattcacggcacatgctcgctatcgttgtactgatgatgagggtaatcctttaattcagcgtaaatatcgggtttgccggacgcttacgatcgaaagcgctgcccgctaccagcgcgggcggcttggttcggggtgattacaggaaggtcggctcggcgcaaaccgctgacgtggcacgaagtgtacgcagccccaaaagcacgataaccaccatgatcaaccccgcgacaatggttacaccgaaccctgcccgcgcgccatagatgtcgattaccatgcccgcaagtacgctaccgagtgctacgccgatgctgatgccagtcgtcatccacgtgagtccttcggtgatcctggacggtggaacaatgatcgtaccaagattcatgacgatgatcatcgttggtgcaaatgacactcctgccataaagagcatcccagaaaggatgtagacatccggtgagaaaataggtaatacagctgtgactgaagttaccagtaccccaatgaagaactgcttttcaatcggtaaggaaatccttaatgcgccgaacgtcaggcccgcgatcattgagccgagcgcataggctgccaggatgaaactagcagacgctagccagccttgtgcgttggcgaaggcaactacagccacatcaattgatccgccaatcacacccatcgccaggagcgccagaacgatggtacgaacgccggggataagtaaggtcgagcttgcgttcctcctgatgcctacgacgaccttcggttctgtctcccgctgcagaagaaatactgtcacgccgatggctagcagcaacacggcaacaagaggtccggcttcggcgaaaaaactggtgctcaggccaatggtgagtggtgggccgattataaaagcgagttcagttagaacagtgtccagggaaaaggccgtgtgtaattgcggcttgccacggaaaagctgcgtccagcgtgctcttatcatagcgggcatgcttggcatcgtgcccaccaatgccgcaagaataaaaagcagtagagtcggagcactcatatagacagcaattatcagcgccagcagcataccaatgctgaaggcggtcataaagggcagaactcgactctggccccgctgatcaacgagtttcgatacctgcgggccgataagcgcattcgtcagggcaaatgtgccagcgattgagccagccagccaataaatacccgtctgctgcaccaacatggtaatgatgccgatgccgatcattgcctgtggcagacggacaatggaactcgcgatcactaaccccatggctccgggggttgtgagaagttcgcggtagggattagccatggtttctccagtttataattcgacgctgatgagtatcccgttgaacgggatgcaaacttttgggatggtttaccggcgattgaagggtgcatttaatcgagcaagcaaatgaggtagttacagcatttgtaataaccccacttgcatgtagatgagcgtaacgctcaatcatcgcctcttacaaaagcgctctattatatagatgaggcgcatcagtcgaatcatctcaccagtgttatcacacataaccaaccctaccaatgcctgtcccagatagctcgcagctaaaaatgctggtatatttctgcccatgaaaaacaagattcatggccaagcaaaccagaatgtttcttttctgcagtagagataaacaatgatctttgagaatactcagcaagaggacttctatccgatttcatctacgggttctaccaacaccaagagcctaccccctgacacatcgaagtcaatgatgttatttcattaatacgatgccgtcacattctatctatggtgcctgagtgtacccttaagcggcatacatttcgtgctctagtaaattaactaataatcactataaaaaactatatgtcaaggaaacaggttctttcgccgacagaaagataatcattgctggctttacctgaagatgaactgaccctgacccgtatgacatatttcagtgagcaggatgttgctctgattaatgcacacagaaaatctgaaaataaaatggggtttgctgttcttcttttttgtttgagaagcatcggttttattccggatataaattcaccacaccccgtttcattattgaaaagcatcgccagcaggctcaatttgtcggatgaattctggcaggattatgctttggggcgtgataccacctggagggagcatttaacggaactataccgttatattaatctgagaacgtttacaaaacagatccagcaggattgtatcggtcatcttatcccgctcacgacacgtaccgataaaggtatcctgctggctgaagaacttttggactatcttcagcaaaactgcattattatttccggtatggaagtgttggatcgcatctgtgcagaagcgatggccagtggcgacaaacaagtatttacagcactgaatacccagcttactccgaagcataaaacggcgctcgacagcctgttgccctcaccaaataatcagctaactgggtagccgaccagaataaggctaaaaaatgtatacccttggtgaattcgtcgcaggtaaagcctgttccgataacaaacgggaaaatgcgtgttattttgaaagtacggctgaaacaaagccagtcagcgacggggataatactattgaattaaagatcactattcctgaaagaccctttattgctaaagaatatccaattggtcatgaaaaagatccgtttgaaaaaaataaatttgaatcggaaattcagggtagaattgcaagaaaaacttatccaaggcaaggatgggctagtttatgtggcccagcggcatttttttattgcttacagaaggataggccagatatttatgagcaatctgcccgtgagctatggaaatatggtaagactaaaataggtagattagacattaaaccgggtgatggttgccgccaccctagcggttctttctataataacggagaaccaacaatttcaggtttagattggataacattagcgagcttaagagactcagaaaatgctatttttagctataatcaagttgaagctgaaacagcgggagttacaatgtgggggaaattaaccgaatggtttgagaaagcaggttatgagaaaatttttgataatataagtattttttcccatagtaatatcaatgatataataaatttaaacgattatataagaaaagggtatattgttgtaagtttaatatcggttggaatgctaaaaggatcagctggtgaaacttcaggtaaaaatcattggattgtatgggaaggtgaagttagctcaaaaggaaagtcaataaatctaaataagaattcaaaatagtagatcacttgagggaactcagtccgatttttacgatctgatcaatggcgaaaatcacaaatcaccaaatggactgagttatgcctatcatagcacccatacctcgaaatgaacgacagaaaatgaaaaagcttatccagaaaacccaaaataaggattatgctcgccggatgatggcattattaatgttacacaagggggatacggtttctcacgttgccaaaaccctttgtgcctcacgttcttcggtcaatcgctgggtaaattggtttacattatatggactggacggattaaaaagcttaccgccgggcaggccggccatctggaatttagagccacttctcgctgtggtttctttcttattaaaacactccccacaacatttcggttatctccgctcacgctggagtcttgagcttatcacacataaaatcaatgtattactggatatatcactctctcaaagtaccctttatcgctacttttatcgggcggggatcgtctggcgaagagccgcacccacgttaagattgtctgatcctgaacatgatgaaaaaagggcaaaaatcaccgggtcttatccaatgcctcagagcaacatcctgttttttatgaggatgaggtggatattgaccttaacccaaaaatcggggcagattggtgtttcaagggacaacaaaagcatgttgtgacccccggaaagaaccagaaacactatcttgcgggctgcctcaacgcgaaaacgaaagaaataacttatgtcgggggcttaagaaagaactcggatttatttattaagttgttagatacacttaataatcaatatgttaatgcaaagacgatcaccttgattttagataactatggcattcataaaagtcagaaagtcatcgcgtggctggcaaaaaatcctaaatttaatctcttgtttttaccggtctattccccttggttgaataaaattgaacgcctgtggcaatccctgcatgaaaccgtgacacgaaaccattgctgccaatttatggggcagtgacttgaacatgtaaaagccttcatggaaatcacttcattacaacagcaaaaacctgggagggtaaaaatgggtgtatcatcattatgaattcttatttaacctgaggtttgcttaagaagggaactaagtgcctgaggcacgatcaaagtttttgtcaaagaaaacaaaatcgtggagatcctcaggcatgtctaatttagaagaactttactgctgcgtcgatgacttttgccaaaaatttattcctctctggcatcaacagttaattgaaaatggcttgctcaaacgtcgccgcgaagcttccctttctctcagtgaagtgatgacgctcctcattttattccacatgagccattatcgtgattttaaaacgttttatattcagcatgtcaaacactaccttaaagccgattttcccaggttggtcagctacacccgtatgttaaccttaaagcacagggcgctcattcctctctgtgcttttttttcgtcacgcaaggctgaaacccaggggatcgcctttattgattcaaccaaaattgctgtttgtcacaacctccgtattccccgtcatcgcgtatttgagggcgtcgcacagcgagggaaaacgagtacaggctggttttatggctttaaacttcatttggttatcaatgattgtggtgaacttttagcggttaagctgacctcaggaaataaagatgatcgtcatcccgtcaaagcactggtacaagggttaacagggtgtttgtatggcgataaagggtatttgtcacaggccttgtgcgatgaactggaagcagaaggaataacgttaatcactcatgtccgtagtaacatgaaggcaaaagcgttatctctctgggataagctgatgttaagaaagcgatttttgatagaaacggtcgtggatcagctcaaaaatatttctcagatagcgcattcaagacaccgtagtcagctcggttttttattggaaatcgtcgctggcttaatagcttatacattccaacctaaaaaaccgagcttgaatttacgggattgtgatatcgctatttttaaacgaagctgaggttatttagatagtgaaaatgaaatagttaatttaaatatgtttacttggggaggaattagtgagcgggttaaacctaataatgatttaaattattttttaaaacatacatttggagggttggtttttaaaccaataaaataaaaatgagaaatattttttttcattatatccatcttacttgtttctgcttgtacaagacaaactgtttccatttatcctaatggaaactatttaaaagatgctcaggtaggagttccatataatgaaataataaacataccgggtgttatagatatgggtttttcagccaaaataacaccttcaaactcaggtctatacccatcgtaattgaagatacttgatttttcattcgtatcagatcaagatcgcgcccatgaaaattactctgacagatgcccaaaaagaagccctcgaattgatgcacgatacgactcgtgatgggcgcgtacgtgaccgcatcaaggccgtgcttttggcctcagaaggctggactgcccagatgattgcccaggctttgcgtattcatgaaagtacggtgagtcgccatctgaaggattacgtctctgaggaaaaactcgcccctgaaaatggcggctctgaaagccgtttatctgccgaacagacgacagaattagtggagtatctgacggcaaatttgatgcacactaccgcgcaaattgtggcttgtgtctgggcgcgctggcaggtgactttcactgtggctgggatgacaaaatggctccaccgccaagggttcagctacaagaagccgatgggaacgcctcataaatccgatgtgtataaacagcaacactttattaagacctacaacgcgttgaaagctgaatgtggccaaaatgcgcctattttgtttattgatgcgatgcatcctacccagtccacaaaattaagttacggctggatgaggcgcggaagagagcatgtcaaagtggtcgaaaccacaggcagccggacccgccttaacatcatgggcgcactcaatttgcaacggattgaagagaccattattcgtgaatatccgacgattaacgcgaaaaatgttgtcctgtttttcggctcaattcgagaaacctatccgctttcacaaaaaattcatctcattctggatggagccggttaccaccgcgctgaaatagttcaattttttgccgaggtcctgaatatcgagttgcattatctgcccccttacagccctaacctcaacccgattgagcgattatggaagtatgcgaatgagcaggtacgaaacaatatctatttctcggaggcaaaaacattccgtgaaacgctgcatcacttttttcatgtcacattgccagaaaaagcgaaagaactcaccacccggttgacagataatttccagactttaattcctgcatcttcaagttaattgcgtataacatggaatcctagcgattataaaacccctgttctgacagcaacagaaaaagactatagccgtattcagactcaaggaatgcctatacatgccggagaaataactataaaaatatctggtggtgtttatggcaatatgtttacaaaagtaggtaaatttaataaaatctacacaataaaagtgaaagaatgatttttattattagaatggcgatttacatcgccatttctatacttgtatgctgttctcaacagaatcataattctttcttattattttcatgatgttaaaagttatttgctgaaaaaataactattctgaaaaacaccatgaaaaaactactcgaattgcgccaacaaaaaactgatttaacccaacaaatgcgctcgctgctgaccagagccgaagacgaaaagcgctccctgaccacagatgaagcgaaacagttcgacgacttgcgcagccagtctgatgtactcaatgctgaaatcgctcgttatgaggtgctgtctgatgaagaacgcaatcaggtaaagaatcagacagccaatgaaaaactcagtaatgacgagctacgcaattatattctgaccggagaaacgcgttccttgtctacaggcgtcccggtagacggcggttataccgttatccctgagttgaacaaacaaatcatgcagcaattggctgatgaatctgtcatgcgccaaatctgtactctcaaaaccacatgcagcaacgaatataagcagttggtttcggtcggtggcgcagcagtggcacacggggaagaaggtaagacacgctgcgagactgccacaccgaaaatggaagaagtcagcatcaaactgttccctatttacgcctatcccaagacgacccaagagattatcgactttagtgatgtggataatgccaacgcacgacgaacgaccgccaccaaatcaggatgtccatacccactaacggcgagaaaacccctttaatccggatcacatcctcaccatgagcgttagtttcttgctccgtttcataccacagacgcgcaaccaaatcgtcacgacgtacaaacgggccaccctgtgcattgatataatttgcccagtcgccgttatcagccgcatcatgcacagcggcaaattcgatacttaagcccatcgctgcatcatggtctgccatgcggcgcagttcacggtaaaccgttaccggagcaccaccgacaaattgaaactgacggatacgccaacgtgctgcccaagcactcgcagctatcgcggcatctttaatggggcggttactttcatcatcccgctcgtcgtccatcgcgtagccatcaatgtttttagaaatgtatttcgccacatagcccgttgctgaccctttctctggatcaatcttctcggcgtgaaaccgggctttcagggctttttcagtccgcagttcgtggcggtcttcctgcaaggcatactcaccgataatggcgcgcacctgatccgcttggtctggctgcataaaaaacagcatatgccagtggggtgtgccatcgtgatgaggttcagcaacgcggatgccaaagatacgtaaattgttacggtggagtttggctctgatttttgcccagagaccacttaaatattgttgtgtatctgccgggctgcatccgttccacttgcggttacggtgtccgtggcgggtagtggcgtgatatttagagggggcggtcagtgtgtagaactcagcaacatagcccagttcattacagatattttcgaagccccggatgcgcaccatcatttcagtacggcggatcgcaggattggccacactgccataatatttatcaatcaggctaatgcggttaccttcttcgtcttccagttccatcgacttgataaattctttcgtgcggtgcttctgctccttccattcggaaatcgttgttttgctggcgtaagtactggattttttgctgacgcggttaatggagatctgcaagtgttcgcgccactctgccgccagacggcgcaggcgacctaaccaccatttatctgaggtcatgcgagaaatggccgcgataacctgcgtttcatcaaaaaagcggccagttaacttatcccagtaaggagcgtcttgacgataggctttggtgatagcggcggcgcgcatatagagaacatgcgcccgtttcagatcaccgtcttctggtagcatgtcgtctgccactgtttgcaacttctgagtaacaaattcagcaatatcatttgccagcagttcgagatcttcccgcgacatatcaggaatacggttaaaccgcgccatatacagcgcgttatccgctgaaatttcctgaatttggtaacggttggtcaccaacgtaactctaggcaagatacggtcaacgaatgtcttagataaaaaagcctcggcgcgtggcaccccctgctccttttctaaaacactagctttgtattgaacatcgaggcgaacaatagacggttgttttcttaatagccgctgaacgcgagcgcgttctttgatcgcattggcaatcgtccgattttcttcttctttctggtattgctccgcataagttgggaacggtctggttattggcagaacaggcttattccacggcgtagaaatgcacgcagccaaagctgcactttgtggcatctctggctggaatttgctgaattggcggcgcggttggggttgtacgccgctggttataggtacgggtttcactcaccaaccccagcagacactggactacatgcctgatgggcattctcattagcaccttcataaaaaaaatgctcaggcgttaataatgaatattcataaaatgagatattggtttcatcgggattatccagcccgttccgaagataataaacttcatcaattgatacagtgattcgatgctcgatatcatcaagccaatcataccccccctcctgagaaagcactacatagtcaccttttttacagttggtcggtaaattttgattatcaaaaatattttcaacacccacacatctaacaataaagcattggtttaatctatcgagtatttcgacattaacgtcctcgcagcaactatttaaaacaccaatacaacggtttttattatttttaatggtggaaaaatcagtttcatcaagattaacaaagtgaatactagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacaccatctagccatctcatatactccggtaatgttttttaattaattcaaaatcagcctgacaatccacacagcgggagcagccaagaacctgagtacggcgtatttcaggaataccggagaatggattgctgatttctacgcagaagatcgctctgatggcaaaaagggaaagcgcatccgcaagaaattcgccacaaaaggagaggcattagcttacgaacgctatgagttagataaactcaatggcaaaccgtggatagaaagcaatgccaaagacacccgtagattacgtgatttagtcgaaatttggtataaagcacatggcgttacgttaggcgacggagcaaggcgacgaacaacgatgctttgggcaagcgagtgcatgggtgatccacttgctatcgaattcactgcacaactgttttccaaatacagagagcaaaggctatctgggaagctttcaagaactaagcgtgtcgaaacagttgcaccccgcacggtaaaccttgaattatcctactttcttgctgtttttaatgagttaaaaagattgggagaatgggaaggcgataacccccttgagaatgtcagggcgttcagaactgatgaatcagaaatggcttttctaacccatgaacagattgctgacttatttaaagcctgtgaagagagcagtgctcaagatttatctttagtagtaaagatagctctatcaactggtgcaagatgggcagaagcggaaacgttacaacgctcacaaataacgcagaataaaattaccttcattaaaaccaaaggcaagcgcaatcgaactgtacctattagccaagatttgtatgacgagatttctaataagagcagtaagaaagggaaactgtttaccccttgctattacgcattcagatcagcaataaaccgggctaagattgaattaccagacggccagctatctcacgttctaaggcacacttttgccagtcattttatgatgaacggtggcaacattttggtactgcaaagaatccttgggcatacagatataaaaatgaccatgcggtattctcacttcgcacctgagcatcttgatgatgcagtgagacttaatcctctatcgcggaagactatatgaaaaaattattcaaggagcacgggcactactttattttagttatcattatctttattgctgttatttctctcattctttacttttatacgttcaacagttctctatctaataacagtggagattggggagcgtttggttctttcgttggcggaatttgggggcctttagctacaattggaagtattgcagttcttataagaacactcagaacgatgcagaaccaactaaaagaatcggaaataataagaaatttcgggcatatcttagaattattgaaggctctgaatagcataatgaatagagttataagtaatcagaaagaagctgacaataatggtctatataaatggatgactgatagcatagagccgattgttgatgacagcagtcatactcaagaaaaactgttggacataggccgtaaagcggcaagacagaatagtgatatcaaaaatggctgcatagttctcacagaaattctacgaaagataaaaaatatagaaaatcaagaatcacaacaaactgcaaaaattatgctgcaaagtagtctctctgaaacccaccgttttttgctctattgcggggctaatgagcagaattttgaaattagtcaggaattagaatcttatggcttttcagacttgccctctagtcttaacaaaaagatttattgtgagaaatttcttgatgaagatggagaccccacttaaagtgtcgcaaaagtgtcgcgacaaaaaagaaacatcgaataatattgcactttattttaatttaacatgttgttttttattttaaacatatgatatcacaatgccaatcacggtactcataatcgcttggtcgctggttcaagtccagcaggggccaccagaattatcaaggggttgcatcaaaagtgcgaccccttagttttttctaggatacccataggatacaggggttacgcatgaaaatatttagtggataattctttcatttttagagggacgctaatgaaagaattagtggatgtcttttctgattttccagacccacgttgtcagggaaaggtcaaacaccgttttattgatatcttagtgatcgcggtatgcgctgtcattgctggggctaacgcctggactgatattgaacagtacggtcaactcaaaaaggattggctgagttcatttcttccgctcaaagagggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttagccgaccaaaatttcatgcgtaacccctgccataggataccttctggcagtagcgtgaggtataaccgattaacactgctacggcaatgagccgttgtcgtatctttgtccgtgatatttatcacatcccctgaacatactatgtttgcctttcttctttcctaatcaccattcgaaatgcaaaacgccatgagttctaaaatggcaaagtttggatctcaagaactggtgagtaattattccagtagtttattgcgagcgtgacgctcaattaatcggccatatgaatcaaaatagcgactcggccagatttctgagggatgtatttcgagatagttagcaataatccattcgcctttaggccacggacgactgagagtatttgctagtgtagatgaactgaggccagattcacgagaaacagccgctaaggttgtaccacgtttacgtaatgcagcaataatatcggcttgatgccagtcatttttaacgttattcattcctgctaccccttccattaattaatattgatggtggcgattcaaacagggttctcacaactgggaactatcttccagcgaggccgaagcctcccccgtctgaaccgccattgaaagggcgatcgcagacacactggcagaaacttcctaccagtggatagttctttacaagggtgagaatccttgaccactagattttgctaatggcggggctactttaactgattggtttatcggactcaataagcgaatcagtataaacgcttaactttttgcgttatgtgctattaaacagctcatgcgagctgtccccttgctactctggattcaagtaaatatgacaatcagctcagtgccagagccaaggcgggattccacttcgttcgtaatttaaccaaatataagctcattacgaaattcgcctgaccacccagccctccggcgttttgctgcatgactgtctttcatcctggtatgctgtttaatgacatttaatgcaatccgattgaagagtgccatttgtgccgcaccctcaggatcttttagcgataaggtatcctcccgaaaggtcatatctaatacccaatgtaattcattctcaatagcccagtgtcgtctgatcgctttcgcggccacttcaggctccagcggtaacgaactgatataccagcgtgaatcacggtgaatttcccctttctctcccctctcgctgaccacttcgattaagctgtgtacggatggccactggccctgaaggtctttaggaagtccggcactgatttgcataacagcgcgaagttctgtacgtccatgtcctttatttttctctgtaaattcaacccgttcatcactatcgtagtggctggcaaaacgcgattttacaaattggtaaagagtactttgattgcctttaataccgacgatagctaatgattgaatgaattcacctcgcttcggcggggttttgttttttgaaaggtaataaaaaaatattacaaatgcgttgacgtggtaataaaaaaatattactattttaccatgttaaacagaatggagggttagtgaagcagagtgagttcaggcggtggcttgagtcccaaggggtagaaatcaagaatggaaagaatcacttgatactcttaaatggagacgcaaggagtgccatgccaagacatccgagtaaagagattaacgaaaaattaaggttagcaatccttaaacagttaaaactcaaataactaaccagccccttaaggggctggttcttgggctaactcgaatcactactatgattatgcgatatcccgtaaatatcgaagaagacggaacgaacctgtttgtatcgttccctgatatacctgaagcgttgacgtgtggcgatgatttggctgatgcaaaagtgatggcctatgatgcgttactgactgccttttccatgtactttgacgatgaaagtaaggaaattccgttaccgggtaatacggtaacagagcatcatattgatattcctgctagcgttgcggctaaaattcttttgcttaatgcaatggtaaggtcgggtgttagccgttcggaactggggcgccgtgttggaattcaaaagcagaacgtcaagcaattgctggatgtttatcacgcgacaaaaattgacactgtagaaaaggcgctatcaagtttaggttacgaattaatattgacggcggcttaacctaattaacttcctcatcaaaggctactcttcggcgtagcctttttcatgccctcataaaacacaaccagccgcacacaacgccattatcaatcaaatcaatccatacccgtggttaatttggatcgcgttccctgcgttgcgcccacgctgcacaatccccacgaaataaacgtaaacccgacgtaaaacgcactacaccgcacccgcctgcacgttttggatcaaaaaattatttcagttttaaaattcgacaaagggaaccgccagagcgccccagcacaggcggcgtgagagaaaccgcaaattgaaatgtgtgaaaagattttcagtaaatttcagtttttggatcaaaagcggatcacggggaaaatcacaataacatgataataaaagaaaaattccattttacgtggaaaagtagatcatggagaaaagccgcgctgaactgtgggattcaaactgggtgcggctttgttggatattaggaactgaaatttttgagattacttgctagttggcagcgcttctaatagtgcttgtttttgggctgaaaaatctttttttgtaataacgccatcattaacaaaatcatttaatctatccaagtccttagccagagtttctatgttcacagtagctaaactatgatcaagattcgcagccaagatataattttttagtgtattaaactctttggtattgatgacttcaaaatctttcaactcttcaataagttctaatttttcgactaaagagcttgtatctaaaataggttgcttagggtcttttgaggggatagtgcttgctgttgtttgtgattcagagggttgtgatacagtctgtttatctggagctgattcataaccccaagatctccacatgcgagagataaatttttcaagaggctttttctcaatgttactgaaaacgtattcttgatcgtcgatgtggaaaacgatttttgcaaataatagtcctttcttatcttcacaccctgttattgatactacagggaacttatcatgatgtacttttttgaaaagactaattcttacgaaatgaatgttagtattggtcagtaagattagtgttccttttttaccatctaaatcacctgatagaactgctatgggatattcgtcagttcccaatttcctgatgatataaagaaactccttctttcttcttgatactccaacagagctatcaccagatagcttattcagttctgctagtaaatcagagtcagatgcaacgttgtaatcaatcatgtgaatcatcctttagataaatatccaataagcacaaaaggtactatcagttgaaatcgtgtaaaaatcagcttgtgtgatgattgggatagggaacgtaaaaaatcttgtgagacatttttgcgacactgactatagaaaacaaaaaagccacttgttaaaaagtggcttaatgcactgatttatcagctaaaatctggtggcccctgctggacttgaaccagcgaccaagcgattatgagtcgcctgctctaaccactgagctaaggggccagtgaagtgggagaattatacggtacagtttggtctcaggtctagtcccgaaaattcatatgcgcgttttatgttcaataatcagcaacttttaacgtaatttaaccgtttggtggtaagctaacttgggttttagtgattccggtcgtttttttgataaattattctgattacttatcgtactttgtcgtactctaacagagttagattggcacttttttttgctttccattgattttcatccgttctcatcactttctataaaaatatttctgtgaattaatatgaacaaacatcatttgtcagcggctatttttgaccatcatcaaatagaagataaattcttttcatctatcagccaaatgcatgcgcatatcagtgaacatgttcgagcctatgtgactgggcttggaacttatgctttaaattttttgttagtgacagatggtcacatgaaaacagaagaggcgctgaaaacggctattcagttgatggatgaaaatgtgagtgtcccttttggtatttttgctgtggagcctgacagcaaaactctagaagtgatccagcaggccgggtttgtgcccgatcccgatagtatgacgacggctatgcggctggatttggctaattggcagatgagcgagggtgcatttttggcgtatgaaatcagaaatgttgatcattgtctggcagactgggctatcccgatagaaagtgcgtttgaaacaggaaatatgctttcaggacaataccaggtatgtcatcaagctgctttggacgcaggaaaatgtctgcaacattatgcattatatgtggatgggcagccgctctgtgctttaacgttgtcgagggtggataatattgttcgtcttgatgatattggcacagtagtgggaaagcaggggaagggatatgcttctgctttaataaattatgttctgcgtgaggccaaacagcatggtgcgggcgcgtgttatctggatgcttcccatgatggtaatgcgctgtatcaaaggattgggtttaagccattgtttgaatatcagggatttatccgtgagtcataaaaaaacgcctgtcgaaacaggcgttttttaggtttatgagcacattccctgatcagtcatcaaggaagctgcgcagtacttctgaacggctcgggtgacgcagtttccgcagggctttcgcttcgatctgacgaatacgctcacgggttacgtcaaactgtttacccacttcttccagcgtatggtcggtgttcatgtcgataccgaaacgcatgcgcagcactttcgcttcacgcgctgtcagcccagccagcacatcgtgggtggcagaacgcaggctttctgatgttgcagaatccagcggcagctccagtgtggtatcttcaatgaaatcccccagatgtgaatcgtcatcatcacctactggtgtttccattgaaattggctctttggcgattttcagtaccttacggatcttgtcttctggcatcaacatacgttctgccagctcttccggcgaaggctctcgacccatttcctgcaacatctgacgggaaatacgattgagtttgttgatggtttcaatcatatgtaccgggatacggatggtacgagcctgatcagcgatagaacgcgtgattgcctgacggatccaccatgttgcgtaagttgagaatttgtaaccacgacgatattcaaatttatcaaccgctttcatcagaccaatattaccttcctgaatcagatcaaggaattgcaggccacggttggtatattttttcgcaatcgaaataaccagacgcaagttggcctcaaccatctcttttttcgcacggcgagctttggcttcaccgatggacatacgacggttgatatccttgacctgctcaatagtcaggccggtttcttcttcaatttggcgcagcttttgcaggctacgcatcacatcgtcttcaacttctgacaatttatcagaccacggcttgttcatcgcttttgctgcggtgaaccaagtatcagtcgtttcattgccagagaacagggtgatgaagtttttcttcggcattttgcacagttcaacacacatcttcatgatttgacgctcttgaagacgtacgcgatccatcatggaacgcatattgttgaccagataatcgaactgtttcggtatcaaacggaattgtttgaatacttcggacagcgttaaaatttctgctgcggtattcggatggctgcgaccgtaactcttgattgactgacgggtcgtttcatattggtcgcgcagttcctgaaacttctggcgagccaattctgggtcgatgctgttatcatcttcgctgtcagcatcgtcttcactttcttcgtcatcatcatcgtcagagtcatcaagctctgcctgaggaagttctgaaccaatgtgagtggctgtcggtgaaagatcttcttctgcgttaggatcaacgaagccagtgatcaagtcagacagacggctctcgcctgcttctacacggtcgtattgctccagcagatatgtgatcgcttcaggatattcggcgacagagcactgtacttggttgatgccatcttcaatgcgttttgcaatgtcaatctcaccttcgcgagtcagtagctcaaccgtacccatttcacgcatatacatacgaaccgggtcggtggtgcgtccgatttctgactcgacactggataacacctgagcagcagcttctgccgcgtcttcatcggtatcgtttgtgttttctgccaacatgagatcatcagcatcaggtgcttcttccatcacctgaatgcccatgtcattgatcatttggatgatatcttctatctgatcagaatcgacgatatcttccggcagatggtcattgacctcagcataggtcagatagccttgctccttacctcgggtgacaagtagctttagctgtgactgcgggttttgctccataagacggtatccacacttcagagtattggttggtatcggtcggcgaaacaaatatgccaacaataagttttcttgtattgctgctttctttaatagaggcaaccgtagggctatgaccctacctaatgcggcatttaagccgtgaattctgtgtcttcgtactaaaattttggtttagaacctatttcatcaggctatattgcaataatcaccaattgccatataaccgagtaatatagtcctgttgagataggctcttattttctgccaccggactccgtgattaatctgacttcttcacgttcttctggtgtcaggccttctgttctttctttggcaatcagaaagctgaaacgttcatcaagcgctgatgcgaaaagatgattcagcgcatcgctaaaagttttttcagcaatctcatctacctgtatatcgttccatgcggcgagtttttcaagctgttttgcgtactcattatcgcgatactgctctaaaagttgcccggttgttaagcctggttgtgcaagacatgcgtcgacaagctcaatgaataacggtaatcctgctatctgagctgaaaacaatccttgtaatgaaggaactaatgtcgctaaatgcggattttgtaccagcaatgcgatcaagatacgcattgttgttggcttcagttttagcgcctgatatgcactggtatctcttttgacaagttttgccaaaaatcgttccaattgtgttgtatcaggtgttcctaacaggttaccaagttcttgcagcaggtagagtcgcagcgtttctcccgggacttgactgatcaacggcatagcaagcgagctgatcttagtcgttccttccggggtactcaaatcaacctgtggtaacagtgattcgaacaaaaacacagacaaagtcagcgctttttccattctttgttcaaatacttcacgtccttctttgcgaatcagtgaatctggatcctcgccatcaggcaagaacataaaacgtaattgccggccatcattcagatagggtagcgccgtttccagcgcccgccaggcagcatcacggcctgcacggtctccatcgtaacaacagacgacattatcagttgttcgaaaaagtaactgaatgtgttcggcagtcgtagatgttcctaacgaagccacggcgtagtcaatgccaaattgagccagcgcgacaacatccatataaccttcaaccaccaatagccttgaaagggaattatggttctgctgtgcttcataaaggccatataactggcggcctttatggaaaatttctgtttccggtgagttcaggtatttgggaagcgcatctcccagtactcggccaccgaatgcaatcacacgaccccgacggtcgcggattgggaacatcacacgctcgcggaaacggtcataggtgcggccattgtcgtttgtgaccagcattcccgcgtcgtttaactgcttccggtcttctgcattatgggaaaactgtttcaggacgttatcccacccagccggagcaaagccgacggagaaacggtggatgacctcttcactgagcccgcgtctgagtaaatattgttgggctggttggccgttgggcgccgtcagtgaatgttgatagaaactgtttatcgtatccatcaactgataaaggttttgtctttggtggcgttcgatgtgaccgccgcctgagtttgcttcatagggcacttccagcccgtgcatagccgccagttcttcgatagattcgacaaaatcgagcctgtcataattcatcagaaaatcaatggcatttccatgcgcactgcaaccaaagcaatggtaaaactgtttatcgctattaacagtaaatgaaggggttttttcgttatgaaaaggacagcacgcttgatgatttttgcctttctttttgagaggcactcttatatcgatcaaatcaatgatatcggttcttgctaataaatcattgataaatgcgcgtggaattcgtccagccataagcccttttacgcctgttgatgaacgagaataagccgcgcttcctttggggaaagcacggcctttaactgcagtagtttgttaatacaaccactatgcggatagaccgcaaggattagtacaaacgagtgcggcgtgcgttttcacgagcgagttttttagcgtgacgcttaacagcagaagctttagcgcgcttgcgttcagtcgttggtttttcatagaattcacgacgacgaacttctgctaatacgcctgctttttcgcaagaacgcttaaagcgacgcagtgctacgtcgaatggctcgttttcacgtactttaattactggcatgtgcctatcacctcaatagaaatcgggtttgtcgctggcgggatagtgccagccgtctttaaaatggtgcggaattttacttcaatgaacacggctttgtaaagtgccgaggaaaattgaaacatacaacgccacggactatagcccgcttttcagcgtataaaacaagcaagctgacatcgacgttattaacattaaccacacaggatattcaagtagggtgctgattatagactaaacagaaaaaatagtcagcatgtaaatggagacagttgtgatactgctcatcgacgtgaatgttgatgtgaatagtcgttatagacggatgtggttataaacggatagtgatacactgacgcccgttgaggtggatgcaaaacatacgaatagcatagcgtcgatagagtaacgaatcgaatagtaatacatgaaatagtaataaatcgaatagtgacgagacgaatagtaaaatgcgagttttaggtatagaaacgtcctgcgatgaaaccggaatcgcaatttatgatgataaagccggtctgctagccaatcaactgtacagtcaggtaaagctgcatgcggattatggcggtgtcgtgcctgaactggcgtcccgtgaccacattcgtaaaacggttcccttgattcaggccgcgttgaaggaagcaggtctgacgagcaaagatatcgatgctgtagcttacaccgcaggcccaggtctggtgggagcgctgttggttggggcaaccatcggtcgctcattggcctttgcgtgggatgtccctgccattcctgtgcaccatatggaaggccacttgttggcaccgatgttggaagaaaatacacctgagttcccttttgtcgcgttgctggtttctggcggccatactcaactgatcagtgtgaccggtattggtgagtacaaactgttgggtgaatctgtcgatgacgcagcaggtgaagcattcgataaaacggcaaaattactggggctggattatccgggggggcctgtactttctcgtatagcacagcagggcgaggcaggtcgttttgtcttcccgcgaccaatgacggatcgtccagggctggatttcagtttctctggcctgaaaaccttcgccgccaatacgattcgcaatcatattcatggtcatgatcccagcgaagatgaacagaccaaagctgatattgcccgggcctttgaagatgcggttgtggatacactggcaattaagtgtaagcgagcactggaacaaactggcttcaaacgtttagtgatggcaggtggtgtcagtgcaaaccggacattgcgtaccaaaatgcaggaagtgatggaaaaactggggggagaagttttttatgctcgccctgaattctgtaccgataatggtgcaatgatcgcacttgccggtatgattcgtctgcaagggggcactgaaggtgctctgggtgtgacagtgaaagcacgttggcctctggctgatctcccttctttgcaaaaatgaaaattcaatacgaccacgctaatgatcgctaaagtttagcgatcattgcatcgaatattggttatttattttctaatttcaatgacatgtggtggtgcccctgttttggaaatgctcattttgtacatgttagtgatggtgaatccggtctgttttgccagcgcttcaaattcggattgatagcgttctttacctaacagaagaacatccatgtataaatcaaaggattctgcttctgcattattacgttctttaatcatatcgatgatatatagggttgaatctttatgcatggcttgataacaattctttagaatgtcaacgactttctcatccggccaattatgtaaaacatttttcatgcagtaggcatcatatcctgcaggaatagcggaaaagaaattgccattgatgaaagtaatgccttctgattcttgttgactaaagtcatattggtccatgacagcacagttgatattggggtgattttttttaatttctttggctaaagcgccttttcctccaccgacatcaatgactgatgaaatattatgcagcggaatatgcttaataatatcttcattcattatattggtaacttttgacattaagttatcgaaggtatttttaagaactttattctgctcatgacctaaataatcaaaaaacttctcatgataatgaatttcaaaagacgatttatcattttcttcatttaaggaagcgttatattttgtccaagaactccaacagattggatttaattcaaattttatatgcaatgtctcaaggctattcggatcgcttagtgatgagcactgttcggtaagataaaatttatcgtctttttccagtaatacaccaagtgactgcatgtaattgagtagtcgatgaaatctatcgacggaaacatgacatagcttagcaagttgttctgcggttttgccatcttgagtgcttaaatatgtcggggctttactgtcaacaaaagtaaacagtgcaatagatttacgatagacagtggtcatttctgtaagcattattgatatccttatgacaagcattgtaactattattaacttatgaggtcgttatttaatttatttgaagaattgtttattctaaatcttattaaatggtaactaaggaatattatttttaattcattgtgtttaaatttatttatgattatttttgatagagttattaaaaaatattgatatccgccatttttatttaatataaaaataataaatgtaatcatatccactaattaagtataattaaatgtttttatattattaaaaaatattgtttcttattaataaaagaggttgttttgaataaatctggcagataattttctttctgaataagggttgctacggtggttgaataagcaccagatgcagggcggtgctttcagagtcgctttaatggaaaaggtaggcagccccttgcgggggctatctgttattactcgtcttgctgttcctgctctttaacagcttggattttttctttatccgtcatttcctgtttctttttcagcttctgccaaatacggctttcctgcccacgccaaaggcgctgaatattatcgtgatggcgcagaagtatcagacaggaaagcatcgcgacgggaaaggttaattcaggtttaaaccaccaaacgtagaaaggagcgatcaacgcactgacaatggcacccaatgatgagtaaccgcttaacagcacggtcagtagccatgtaccagcaattaatcccataagatcccaaccaatggcggcaatcgccccaaacgcagtcgcaacgcctttaccgcctttgaagcggaagaacacggggtaaatgtggcctaaacaggcggcaatggcgataatgcccaaataggtgggttggatattgagtttgtacgccagccaaaccggaatcattcctttcaggacatcgcagataagcactgccagtgcagcacctttgccaccgatgcgcagtacatttgttgcccccgggttaccggaaccattctggcggggatcgggtagtcctgccaaacggcagatcaatatcgcgctggatatggagccacataggtacgcgaagatgatcatgccaagtgcgatagcactcataagatatctccaatgaataagggtcgttttcttaactctaacaatggataatacgcacatttgaccggaagtggtatccggtgaaccgaaaaacggggaaaaggttgtgatggatatcgtatttatagaagaattagcggtcattactacaattggtgtttatgactgggaacagacaattaaacagaaactggtgttcgatatcgaaatgggatgggacaacaaacgtgcgtcttccagcgataatgtcgaacactgtctggactatgccaaagtcagcgaagcggtggtccactatgtggaaagccagcgttttgccttggttgagcgggtggcagaagaggtggcggatattttactgaatcaatttcattcgccctgggtaaaaatcaaagtcagtaaaccgggcgctgttgctcaggcaaaaagtgttggtgtggtgattgaacgtagtttaaatggtttagtgtaaatggctgatttgatcagctactgcattaaaaaaagcgcctcaaattgataggttatttagggcgcttttaccaattaccggaaatgatcaagcatcaggcattaaccagtagagtgttgtttccatttggtgatggcgagctggcgttgcctatctaattcggtacggatctcagcgccctggaacccacgagcaattacgtcttggacattcacctgactgacagtggtaaaggcgtcacgcaaataacgcccctgcggatagcgggatgcttccagttcggcatatgcacgggtgtcagcttggctacaaagaatcaactgctcaattcgttggggcttgcgccatgcgtccacggcattaaacaatgccagcagggtttctggaggcaactgctcggcagtgtgtacccaattgtggtactgcgccacaatgacagcaagatcgcgtgctgcattgggaatgcgcagtcgttcgcacatctgcttaacctgcatggcttcggtgtgcgcgcacaatgaggcgaaacgaatatcgatttcttggctcaattgagtggccatgtgtaaggccttcaatgcatgaatgcctgcatccatttgaaggggggctttctcccatgaggaaatgggggctacaccaaacaggcgatcgatctctgggaaaagaatcgccagcgcaccacaatcacgtaaaacctgaaagtagatttgcggtgagggtgacgtaagtgccttttcggtttcccgccagacccgttcgggcgtcagggatgacaactcgccactcttcaccatttttgtgatgagtgactgagtttccggcgcaattgagaaactcaggtgagcaaagtaagcggcaaaacgagccagacgcagtacacgcaatggatcttctgaaaatgcgccagagacatggcgcaaaatgcgatgcttgagatcatcagcaccatgataaggatcgatcaactcgccttcggcagtttgtgcaatggcgttaatcgtcaaatctcgacgcagcagatcttcttccaaagtcacgtcgggagcggcataacaggtaaaaccggtatacccctgaccggattttctttctgtgcgtgctagcgcgtactcatcatgggtttttggatgcaggaaaactgggaaatccttcccgacctgttgatacccttgagataaaagctcttcaggcctgcctccgactatcacccaatctctttctgtaacgggcagacccaagagttgattgcgaacagcaccgccaaccaaataaactttcacttttactcccttaaattagctcatccagcgatctttgcgtttgcggcgtggaataatatgtggcagtacaagacccagaatgaggccgatccctgcgactgcgccaccatagatgaaccactgtaagataatttctctttgtttatcatctagctgtaaattagccatatctacctttttttcagctacagttagtttgttctggatcttggcattttctttttttagatcattaataatcttatcgctggcagacactttgttttgcatatctgcggtacgttgtttccagtcattatcaatattagccagcttactcgtcagagttttgatctcttgttccatagcaggaatgcgttcatgcaggctgggaatggtgctcagttcattggttaagatccagcttatacgccctttgctatccttgacttgtgagtaaccattttctgaattattactcagcaaggtgacttcttcacctgaattcagcgaacccatgatacggtgttgattgcttgggccgctacgaatgtaagctgataactcatcagaaacataacgtttttcttcagcatgtacggataacggtagagtaaaacccaggaacaggataaataatcgatgtagtttttgcattctgtgctcaactgttcttttctttgtgtatgggactattgtgatcaaactacttaaacggatagtaaagagttaagtttgcaggtgcaatcagtaaaccagaatgagaactctcttaactgaccgaatacagaccttgttcgtggtttttttgcgaagtgagcataatcattgttgagataaccccctattgtggtttattttttctctttaccccaacattccccaaaagaagttactcgcagggagaagcgtgttctcctgcggaacccgcagtataaattgagagataaacatatgcgttctgtagaggtagagttaaaattgtctgtcaagcccgatgctataccggcagttcgccagcaattgtttcagttttcccaccattatttttcaccacaacacctgactaatatttactttgagacgccagataatcaattgcgtcgctgggatatggggctgcgtatccgtggttttgatgggcactatgaaatgaccatcaaaacagccggcaaagtgttgggtggattgcaccagcggcctgaattcaatgtgccacttcatcatcctgaactggatttggctcagtttcctgcccatatctggcctgaaaataccgatattacacaattacaggctcaactgattgcgttgttcagcactgattttacccgtgaaaagtggatagtgaaccacggacagagtgaaattgaagtcgcattggatcaaggtgtcattcgttctggtcatcgaacggccgctatttgtgagtttgaactggaactgaaaaaggggaatgtggcagatattctgttactggcagatagactggcattgcaggagggtctgcggctggcgaataagagcaaagcggcgcagggatatgcccttgcgtatggtttgactcagaccgatttatcgcaggttcccgaaacgttgggatggcaacagccattatctgttcttctgcctgaaattttagctcagtggcaggagcaggaagaaggatggctggcaggtatacctgaaggaaaaacaggattagagcaggttttggtgtgggtagagcagcttatagaacaacaggcggaagctttgcctgtatttgactcattgcctgcattaaaagtggctttatcagcagtgaatgcagatgcagaaacattgtgttacagcgcatcatggctgcaatgtaagctggcgttaactcagtggttgatggctcaagcacgataaaaccagtctctataaaataatcgcaataataacgacacgataacgaacggaaaccctgctatgttgccactttcagtgcctttggctcaccaattacagcatgtcgttgctaatttccaacaatcagcgggaacaataaaatcctttgcgccacatgaacaggcggtgttgtctctgagtgattttgtggcggaaaatctgctgttacatccgacatggcttgatgaaatccgtcagaatcctcctcaaccggaggaagggcaacactatcctgattggttaaatcaggcgctgtctgtggcaagtgatgaaaattccctgatgcgaattctgcgcctgttccgtcaccggatgttggttagaattgcgtggttgcaggcgctacaaggcagtacgacagaacagatattgcaacaactgagtatgttggccgaagttttgattgtggcagcccgcgataggttgtatctgcgttgctgtcaggattggggaactccaaccaatcttgaaggcgtagcacagccgttgttaatccttggtatggggaaattgggtggcggagaactcaatttttcctccgatatcgatctcattttttcctatcccgaaaatggtgtgacacaaggtggacggcgcgaaatggataattcccagttttttactcggctggggcagaaactcatcaaagtgctggatcaacaaacggtggacggatttgtttatcgtgtagacatgagattgcggccgtttggtgatagcgggccactggtgttcagtttttcggcactggaggattattatcaggagcaaggacgtgactgggagcgttacgctttggtgaaagcgcggatcttggggtacgacgagcaggtgtattgccaggaactgcgccagatgttgaggccgtttatttttcgccgttatatcgatttcagcgtgattcagtctttgcgtaatatgaagggcatgattgagcgggaagtgcgccgtcgaggtttaaaagacaacattaaactgggcgcaggtgggatccgcgaaatcgaatttatcacacaggtatttcagctgatccggggagggcgggagccgagcctacaatcccgttcattgctgctaacattgaaagccattgaagtattggcattgttaacaccggaacaggtgagggagcttgaagaaagttatctgtttttacgtcggctggaaaacttgctgcaatccattcgtgatcaacaaacacagactttgccggaaagtacgctggatcgcgcccgcttgtcttggggcatgggttttgtagattgggatgggttgttggcggaaacagagcacagaatgcatgctgttcgaagcatcttcaggcaactgatcggtgatgaaactgacgaaaatgtcgaagaagccagtcatgtgccgtttaagagtgtatggcaggaggctttgaacagaggtgaattgatgacgcttgttcctcatcttgatgaggcggatgctcagaaaatgctcgatgtgattgccctgtttcgtcacgatgtcagtaagcgcactattggcccacgggggcgtgatgttctcgatcggttgatgcctcgtctgctggcaaaaattggggtgagggaagataccaatacggttttggaacgaatggttcctttgctgctcagtatcgtcagccggacgacttatttggagttgatgctggaatcagaacaggtgatgactcacgttatccgtctgtgtgctgcttccccgatgattgccagccagcttactctccatcctttattgctggatgaactgctcgatcctaaatcgttgtatgaaccgttgccactcgaagcctatcgggatgaattgtatcaatatttactgcgcattcctgaagatgatgaggagcagttgctggaggcgttgcggcaattcaagcaagcgcagttattgcggattgccgcagaagacattgcgggtgtactgcctgtcatgaaagtcagcgatcacctgacttatctggcggaagcgattatcgggactgtggtacagcaggcgtggaaccagatggtaaaacgttatggtgcaccagcgcacttgtcccagcagccaggactgggttttgccatcatcggctatggcaagttgggaggatgggaactgggttatggttctgatctggatctggtgtttttactggattgcccaatggacgtagtgactgatggagaacgcgccattgatgcccgtcaattttatttgcgccttgcccaacgcattattcatttgttcagtacccggacggcttcgggagtgctgtatgatgttgatgcccgtttgcgtccatccggtgaatcgggcatgttggtcagtaccctcgatgctttcgatgattatcagaaacatgaggcgtggacatgggaacatcaggcattaattcgggcgagaatggtatttggtgatgagaaaatgcggggtgattttgaacgtattcgacgtgaaaccctatgcaggtctcgcgatccggatctcttgtgtcagcaagtgcgtgaaatgcgcgagaaaatgcatcgtcatttaggtagccaccaacatgaccagtttgatatcaaggctgatccgggtgggatcacggacattgaattcatcgcccagtatcaggtactgcgctatgcaccggaaaacgcaaagctgacccgttggtctgataatgtacgcattttcgaattaatggcgaactataacattatggatggacaggaagcgatggcgctgacgcaggcttatatcaccatgcgtgatgaactgcatcaccttgccttgcaggccttacccagtcgtgttcctgccgaaagcttcagccagcagcaaatattggtgcgcgatagctggcagaaatggcttggtcgctgattgggtcgttgataatgtgaggggaactgagcttttcctgctggatcttgctggcattcagtaaggttatggtaatatccgcaacagtttattttgatatttggagcatgggatgaaagtaatactccctgattttcaccgcgcaggtgttttggttgttggcgatgtgatgttagaccgctattggtgcggcctaaccagccgcatttcaccggaagcaccggttcccgtggttaaggtggacactatcgaagagcgccccggcggagcggctaacgtcgccatgaatattgcgtcgctgggggcacattcacatctgatcggtctgacgggcattgacgatgctgcgcgggcattgaatgaaaaactcagtagtgtgaaagtccagtgtaatttcgtcgctgtccctacgcatccaactatcacgaaactgcgtgttttatcgcgtaaccagcaattaatccggctggattttgaagaaggcttccaaaatgtggatgcccagccaatgctggaaaagatccagcaatccctgcctcatgtcggggcgttggtgctttcggattatgccaaaggcgcactgagtcagattcagacaatgatcaaactggctaatgaagcccatgtgcctgtactgatcgatccaaaaggcagtgattttgagcgctaccgtggcgcaacgttgctcacaccgaatatgtcagaatttgaagcggttgtggggcactgtaaggacgatgacgaactggtggagaaaggcacaaaactggttcaggatctggaattgaaagctctgcttattacccgttctgaacgaggaatgagtttactgcgagtagggcagccacctttgcatctgccaactcaggcacaggaagtctttgatgtgaccggggcgggtgatactgtgattggcgtattggcagcggcgctggccgcaggaaaaccattgaatgaagcctgttatcttgctaatgcggcggcaggtgttgttgtcggcaaactgggaacctccactgtttcgccagtggaattggaaaatgcagtgcgtggccgagcagaaaccgggtttggtgtgatgagcgaagcacaattgaaaaacgtggtggcacaggcgcgtcagcgcggtgagcgaatcgtcatgaccaatggctgtttcgatatcctgcatgcagggcatgtttcttacctgtccaacgctcgcaaactgggcgatcgcttgatcgttgccgttaacagtgatgcttctaccaaacggctgaaaggggaaactcgacccgtgaacccgttggatcagcgcatgattgtgttatccgcactggaatcggtggattgggttgtggcattcgaagaagatacaccacagcgtttaattgcaggtgttctgccggataccttggtcaaaggcggtgattatacgccagaagagatcgcgggcagtcaggaagtctgggcggctggtggggaagtcatggtattgaattttgaggatggtatctcgaccagcaatatcatcaaagctatcaaaaaccagtaagtttgccggattttaccgcatcgttatgccgttatgtttcttgcgggacataaacggcatcgtctaatctatgagggagaattgtgtacagcggcaattctcctcacgcattattccgcctgctcagttttcttttcaattcctgcctgcgggtttccgatacggacctccagttcgtccagacgttgttccattgcggccagtttttcacgggtacgcagtaaaatttgggtctggatatcaaactcttcacggttgacgagatctagcttgctcagttgggattgcaaaacagtacgcaattttttttctacatcatcaccaaactcttttacgccttttggcatagaattatggatttggcgggcaatttgttcaattttctttggatcgagcatgataagcatccttttgtgacataacggtgttgtcgctattttaatacctgatagcgaaagcataaatgattgcgagccaggtttcataattgattttgttgattgcccctacgaattattagagctatagtgcaaatgtttatctcagggcagggtgaaagtccctaccggcggtaaagtgaaagaactttctggtgatttcattaagcccgcgagcgctctgtttgcagttatcttttttgttgttcgcagatgtctcagaacaacgatggataaaacagaggtcagcagatccagtgtgattctggagccgacggtgatagtccggatgggagagaataacagcatcaatcgagcgcttgcgctcgcctgttgttttgttgccgtatttttttgcagcattaactcctcaaaattgccctgattctggtaacccataaatttaaagaggtttttttaccatgaatcagacgctactttccttatatggcacaccatttcagcgtgttgaacgtgcagtcgctgctttacgcgcaggccgcggagtgatggtactggatgacgaaaatcgtgaaaatgaaggtgacatgattttcgctgccgaaacgatgaccgtagaacaaatggcattgaccatccgtcatggcagcggaattgtgtgcctttgcctgaccgaagaacgtcgtcaacaactgcaattgcccatgatggtggaaaataactccagtcagtatcagaccgcttttaccgtcaccattgaagcagcacaaggggtgacaacgggagtttctgcggcggatcgcattaccactattcacgccgccattgcagagggtgcacagccaaatgatctgagtcgaccagggcatgttttccccctgcgggcgcagccgggaggggttttgacccgtcgtggtcatactgaagcgaccattgatttggttaaactggcaggttttaagccagcaggtgtgctgtgtgaactgacgaatgatgatggctcaatggctcgtgcttctgaagtgattgaatttgcaaaacggcatgatatgccagtcgttaccattgaagacttagtagactatcgccagcaagtagcgaaggttgccagctaggtcatattgttttctgccatattgttttcttgggtgaaatagaaagctgttcggaatagaaaacgtatcgggatagaatatatcagttatattgagtgtacgcttgaaaggccgcagtccacacactgcggccttcagtatttttgaaatactccattatttttgattggctgtattcaaggaagaaaagtcgtaatcttgccataatatttttgtcattattgacaatcgacgtaatctagaatgtttaatttgttgtatgagggacgaaaatgagtctcctgagaatacccgctttattcgttggtcatggtagtccaatgaatgcccttgaagataaccgctactcacgtgcttggtttgaactagggaaaaaattgcccagaccgagagccattctggtgatttccgcacattggtacactgatgggacggttgtgacagccatgactcagccaagaactatccatgattttggcgcttttcctcaggcactgcacgatatgcagtatccggctcaaggttttcctgagttggcggtgttggtacaagatatccttgagcccattgaggttgaaaccgattttgaacattggggtttggatcacgggtcttggggtatcttggcaaaaatgtatccagatgcagatattccagtgattcagttgagtatggatcgcaaccaacccgcttcttttcattatgaaatcggcaagaaattagcggtactgcgagatgaaggtgttctgatcatgggcagcggtaatgtcgtgcataacctgcctgccgaaaaactgggagtcgagccttattcttggtcgctgtcttttgagcagtttgtccgcgaaagcttgactagccttgaggaaccacatcccttgttccatgcattggacagggaagatggcaaattatccaacccaacgccagaacatttcctgccgctgttttatgtgatgggaacatgggacaaaaaagagccgatttcaacccctgttgagggtattgaagatggctctttgagtatgttgtcgattcaagtcggataactgcaaatcagccaactgacttaatccaaaatacttagtctaaaataatatgcgggtaaaatcgtgaaagatcttgcgtaatcaactcacgatcttcacggatacaaatacccgcagattgatcatcgaccagccagctgccgaccagcgtatagctatcgccaaattttggcagggcatggaattgctgtacgatcatgccttctttcccataagggccatcggcactggcgatttccctgccttgcttgataatgcgaatattggcaccttcacgggagaataaaggcttaatgacatagctatccatttctgggtagtgttcatcggcaaaataagccagcagcaagttcggatgattcgggaacattttccacagcatcggcagcagcgccttgttggagataatgctcttccatgcaggttccagccagcggacgccagcatcggccagtttggttgagaaaatctcacgcagcataaactcccacggatacagtttaaacaggttgccgatcacttgatcttgcaagtcggtaaactgccctttttcacccagaccgatgtcttcaataaacaggaattccgtcggaatacccgcttctgaggcgcagtcctgcaagtactgaatggtgccacggtcttcctcagtatcttggcagcaagccatatggagcaggccaaacccatgcttttcacgtaattgcccaaaacgctcaatcagcttttcctgcaggctattgaactgatctgcattagcaggcagatttccagcgttgagctgatcttccagccaaatccactgaaagaaggcagattcatacagtgaagttggggtatctgcgttgttttctagcagcttgggcgggtttttgccatcataggcgaaatccaaacgggaatagagcgaaggctggctggttatccatgaagaacggataaactcccagcaatgtttagggatctggaatttagtcagtagctcttcactattgacgaccttttccaccacctgcaaacacatttggtgcagctctgtcgtagcatcttcaatttcttcaatctggctcagagagaattggtaatatgcttcttcactccagtagggctggtcatgcatggtgtgaaagttaaaaccatattctgctgctttttcgcgccagtccgggcgctcggtaataccaatgcgtttcatttttgcttaaccacccatagagcgggaagtggaactggcagatgagcgctgcatggtagactgcttcgctacggaatcaccgaacccgccgcgggtaacggtggttgtcgtcgctggttttggtgccatcgccgtttttggtaccgtcatggtgcgaccgcctgcggcggcagagccataactcttgccggtagcatcaacaaacttgccgttggctgggctggaggcggattttgacgtaaacaacggttgtgatggtgtagaactaccgcccatcaaacgtcccatcatgtagccagccatcaatggcatccaaaaactcccgctgctgctttgagcctgagactgagcctgggttccaactccagcttgagctggggtctgggtacattgttgttcaccaaactcagcaacacactcctcgcgtgaggcatatttcggtgcggttttttccgcttctttcagagcattgttgtaagcggtcttgcattgctcactttgagaaggatttgcctgggagcactcatcggcatttgtatagagtgatacagtttcatcgttctgttcacaggccgatagcatgaaaaccgcactgatagcgagtgccacaggtgccaaacgataatttcgccacgttttacggaaagtatcgtggtttatctcttttgtccgtttcattgtcatagggggcatccaccttggaggtatttgaataagagctaatcccattaatggcgcccaacgggacgggctcttggggatattcttaaaaaatagcccacacaattggcgggctgcttttctttatagtatagcgtttttaatataacgttttttaatcaggaacggtagagcattaaatcagcgagttgttggtgttttcatctctttaataatattgctggcatccgttgagatctttgtgcctagaatattattgagtgccaccagatcatcttcatttaaggtgccacgcgcttgcttattcactagttgattaatcagatagtcataacgcgccttggacaggctctgtttggcctgatacagcttggttgtggcatccagaacatcaacaatggtgcgggttcctacctgataaccggcttccattgaatccagagaactttgtgtcgaaacgactgcctgtttattggctgtaatgctgctgatagaagcagaaaggttattggaggaggagcgaacatcctgaataaccttgcgataggtattctccaagtcctggctggcactgataaagttatattttgcctgttcgacctgagaattggtgagaccaccgctataaagtggcaggcttaatgataaaccaacgctgttaccgccatcgtaggaatcacttcgttgggcaccacggtcatgtttgttggtgaccccagtgcttgccgtcaaattaacggtaggcatgtagcctgtccgcgcatctttgataaattcgcgttttagatcctgtgtcaaacgtgctgacaacaggcttaagttgcgggtttcggcttctttcagcacagaatcaacgggattaggttgattggttttgaattgcacaatattcaatgaagccagttgtgggtagtagcttcctgtcatcaggcgcagtccttccagcgagttttccagattgttacgatctgaaacttctagcgcaagaatggtatcgtattgggcctgagcgttttggacgtcggtaatggcaaccaggccgaccttaaagcgttggcttgattgatccaattggcggtacagcgaggctttctgtgcttcggtatacgttaacgcatcaattttacttaagacatcaaaataagctttggctgtatccaaaattaacttttgctgggcgacttggtaactgatatcagcgatacctgctgatttttcagcctgattcagttgataccattttgacatgtcgaaaatcgtttgcgtcagttgcagttttgcatttgtaccatagttttctgagtctgttttactgcgaaaacttttgccatagtcaacacctgcattcaaccccagttgtggtaacaaagggctacggacttcattaattttttcaacaattgaattgcggtcagcctgtgccttaagcaattcggggttagtttctttcgcctgcttgtaaatttgtaatagatcttctgcatggcttaaagtgctgaaacctaccagattcatagcgataaaaagagagagcaattttttcatttgcgttccttgttgtgcagctattttgcttaatttgcctctgtgtacagaccaataccactgattttagcagagaatgccagtaagctagggaggctgtttgtgccatcttgccttatttttcggcgtgtttgtatcatcaaagcgaatttatttagatcaatgtggaaaaatacattttaataataggcaattaaaaaaataattaggagactttatgagtgaaaatcttgtttcaccgctcacgtttacgacgcaggatgttgaaattatctcccgaaaaacgctctaccgtggttttttcaaaatgaccgagtatcaattcaggcaccgcctgtttcgaggaggatggagcgataacatcaagcgggaagtttttgaacgaggccatgcggctgttctgctgccttatgatccggtacgtgacgaagtggttttgattgaacagatccgcattccagcaattgaaaccagtgaaacgccttggttgctggaagtgattgccggcatgattgaagaaggcgaagacgttgaacaggtagtttgccgggaagcgatggaagaggccggtcttgaagtcaaacgctgtcagcctgccctgagctacctttccagcccgggaggaacgacagaacgtatggcgatttttgtcggtgaagttgatgctgccacggcttcaggaatacatggactggctggtgaacatgaagacattcgggttctggttgtcagccgtgagcaggcctaccagtgggtggaagaagggattattgataatgctgcttcggttattgcaatacaatggctagctctgcaccatgaaaaactcaagacagcatggttagggaaataattcctaatttatgctggaaaacgggaagtgtgtcccagtcagcagatcttttttgtaaagaaacgctagaataattcttatgactgacaggaaaaggaaaccatttggaaagcctgcttaaagtacctgtggcggagggagccacagccagaatactgcaaatcactgatacgcaccttttcgcaagtaaaggcgatgcgctactgggcatcaatacttaccgcagttaccatgccgtactggatgcgatccttgagcagagtattgatattgacttgatcgttgctacaggtgatttggttcaggatcagacgatcggcgcctaccagaattttgctgaaggtattgcccgtctgcctgttccctgtgtttggttgcctggtaatcacgattatcagccgacaatggtcgatgtgctggcggcggcaggaatttcaccttccaaacagatactcattgggcagcattggcagctggttatgctcgacagtcaggtgcagggcgttcctcatggtgaattgacggattaccagattgaatggttgcaaaaatgtctggatgagcataatgatcgcaatacgattgttatgcttcaccaccatcctgtgccatcggggtgcacatggctggatcagcatagtttacgcaatgccccggctctggcagaatccctgaaggataaacgacaggtaaaagctatattgtgcgggcacattcatcaggaactggataaaatgtggaatggcatccgtgttatggcaacgccatcgacctgtatgcaatttaagccacattgtactaattttatgcttgatacagtagctccgggatggcgttatcttgaactgtctgtggctggcaatcgggaagcgaaactgcaaacgcaggttcacaggctgaagagtaatgaattttgcccggatttagattcggacgggtattaatgtcaacgttactttatttacatggtttcaacagttcgccacaatctgcgaaagcaaatgcgctgaaaatgtggttacaccagcagcacccggaaatcgacatgctcgtgccgcaattgcctccttatcctgaagacgcggccagtttgctggaagatttggtaatgactcgcgccggcgaaaatatcggtctggtaggctcttcgtttggcggttatctggccatctggctttcacaatgctttggcctgcctgccgtagtcgtcaatcctgcggtgcgcccatttgaccttcttcagaattatcttggggaaaacgtgaatccctataccgaagagcggtatactctccagcaaagccacatttatgatctcaaagtaatgcacattgacctgctggaatcgccagatcttatctggttattgcagcaaacaggagatgaagtgctggattatcgtcaggccattgcttacctgatgcaatgcaggcagacggtcgaatcaggtgggaatcatgcttttattggtttcgaacattacttccctcaaatcatcaacttcttggggctaaccagcggcaataacaaaaaaattgccaaaaataggtaagtgactggtattatcaacagtatatatcagtactgattagccctttaatcacgaagcaaccgacagaattacaacatgactcaatctagttacaacgcagaggccattgaagtcctcagtggcctggagccagttcgtcgccgcccaggaatgtacaccgatacaacccgtccgaaccatctggcacaggaagtgatcgataacagcgtggacgaagctctagcgggtcacgcaaaacatattgaagtgatccttcacagcgatcagtctctggaagtgatagatgatggccgtggtatgccggttgatatccatcctgaagaaaaagtttctgctgttgagttgatcctcactcgcctgcatgcagggggaaaattctccaataaaaactatcagttttccggtggcctgcatggtgtcgggatctctgtggttaacgccctgtccagaagagtggaagtgactgttcgccgtgacagccaagtccatcagattgcctttgaaaatggcgataaagtgcaggaactggaagttatcggcagttgtgggaaacgtaatacggggacgagtgtccatttttggccggatgagagttatttcgatatcccccgtttttctgcatcgcgtttaacccacttgctgaaagcaaaggcggtattgtgtccgggtgttgagattgtctttaaagataaactcgctggtacagaacaaaaatggtgctatgctgatggtctgactgattatctgctggaagccgtcaatgggttggtgacattgccacaggcaccattcgtgggggtattgcgcggggataccgaagcggttgactgggcgttgctttggctgccagaaggcggtgaattgctggccgaaagttacgtcaacctgatcccaaccatacagggcggaactcacgttaatggcctgcgccaaggtttgctggatgccatgcgtgaattttgcgaattccgcaacatactgccgcgcggagttaaactctctgccgatgatatctgggatcgctgtgcttacgtgttatccctcaaaatgcaagatccccaatttgccggccagaccaaagaacgcctttcttcacgtcagtctgcggcctttgtttccggtgtggtgaaagacgccttcagcctgtggctgaaccagcacattcaagacgcggaacaacttgctgaaatggcgattgccagtgcacagcgcagaatgcgtgcggcgaaaaaagtcgtgcgcaaaaagctgaccaatggccccgctctgccaggcaaactggcggattgtacctcgcaggatctgaaacttaccgaactatttttggtggaaggggattcagcaggcggctctgccaagcaagcccgtgatcgcgaatatcaggcgatcatgccactgcgcggaaaaatcttgaacacatgggaagtatcttcggatgaagtgctggcttcgcaggaagtgcatgatatctccgtcgctattgggatcgatccggacagtgatgatctcagccaattacgttacggcaaagtctgcatattggcggatgcggattccgatggtttgcacatagcaacgctgctgtgcgctttgtttgtccgtcactttcttacgttagtgaaacgtgggcatgtctatatggcgatgccgccactgtatcgcatcgatcttggcaaagaagtgcattatgcactggacgaaggggaaaaggccgccatactggaacgtttaagccgtaaacgtggcaagccgaatgttcagcgcttcaaagggttgggggaaatgaacccaatacagttgcgtgaaaccacactggatcccaatactcgccgtctggtgcaattgactatcgacgatgacaattatcaggaaaccttctcagtcatggatatgcttctggcgaaaaaacgctcggaagatcgccgcaattggctacaggagaggggaagttccttcgatattgaagtatagcgcacaggtagtcaacacagattctgaggaaattaatacatgagtgagataactcacgatggtgtggagcgccagccgctgcacacgttcaccgaaaacgcctatttgaattactccatgtacgtcatcatggacagggcgctgccttttatcggtgatggtttaaaacctgttcagcgccgtattgtgtatgcgatgtcggaactggggctgaacaacagcgccaaattcaaaaaatccgcccgtaccgttggtgacgtgctcggtaaataccacccacatggtgatggcgcctgttatgaggcgatggtattgatggcacagcctttctcttaccgctatccgctggtggatggtcagggtaactggggggcgccggatgatccgaaatctttcgcggcgatgcgttataccgaatctcgcttgtccaaatatgccgaattgctgctgagtgaacttggtcacggcacggtagattgggcaccaaactttgatggcacgttgcaggagccgaaaatgctgcctgcgcgtctgccgaatatcctgctgaacggcacgacgggtattgctgtcggcatggcgacagatatcccgccgcataatgtccgcgaagtagtcagtgcgctggttgctatgttggataatcccaattgttcgcttgatgatgtaatggaatacatcaaagggccggattatcccacagaagcggaaatcattacgtcaaaagaagatatccgcaagatctacaaaaatggccgtggctcggtgcgtatgcgtgcggtgtggtcaaaagaagagagtaatgttgttattacggctctgccacaccaagtatcgggtgcgaaagtgctggaacagatcgccagtcagatgcgggcgaagaaactgccgatggtagatgatctgcgtgatgaatccgatcatgaaaatccaacccggctggtgattgtgcctaaaaacaatcgtgtcgatgttgagcaggtgatgaaccacctgtttgtgacgaccgatctggaaaaaagttatcgcgttaacctcaacatgatcggactggataaccgtcccaacgttaaaggtttggttgagatcctcagtgaatggttggttttccgccgcgagaccgtgcgcaatcgcctgaattatcggctggaaaaagtccttaagcgcctgcacatcctggaaggtttgctgacggcctacctcagcattgatgaagtgatccacatcattcgcaatgaagatgaaccgaagccagtgctaatgcaacgttttgaactaactgaaacccaagccgaagcgattctggaactgaaattgcgtcacttggcgaagctggaagaagtcaaaattcgtggcgagcaggatggactggcaaaagagcgtgacaaacttcaggcgatcctcggttctgagcgtaaattgagtactctgctgaaaaaagaaattattgctgatgctgagaactatggagatcatcgtcgttcgccgttgaaagaacgttctgaagcgaaggcgatgagtgatcacgatatcctgccttcagagccgattacggttgtgctgtcagaaatgggctgggtacgcagtgcgaaggggcatgaaatcgatcctgctggtttgaattacaaatcgggtgacagcttccgtagtgcagcacgtggtaagagcaaccagcccgttgtctttatcgatacgacagggcgcagttattctgttgatccgttggatttaccctctgccagagggcagggtgaaccgctgacgggtaaattattggcattaccggcgggagcatctattgagcaccttctgatagctaaagaagagcagaaattcttgatggcatctgatgcgggttatggttttatctgtacattcagtgaccttatagctaaaaaccgtgcgggtaaggcgcttataaccctgccagaaaatgctaaggtcatgcagccactggagatcaccaacgagcaggatgatatgttgctggcgatcaccaaagagggtcgtatgctgatgttccctgtggcggatcttcctcagctttcgaaaggcaagggcaataaaattgtttccattcccgcagcacaggcggcttctggggaagatatgttgagctggttgttagtattaccagtacaatcctcaatcacgctctactttggcaagcgtaagttactgcttcgtccagaagacttacagaagttccgggctgagagagggcgcaagggaacctcgttaccacgtggattacagcgtgttgagcgtattgaagtggggatgccccggtcataggccgaaggcagtaacaaaacgatttttgttacacaacaatcacaatagcaggccagatttattctggcctgctttataagaggcggctatgttagcaatcattcgtggaattattgtttttctgttatcaatcctgatatgtctatttggtagtatctactgtttattcagcccccgtaatccgggtcatgtcatgacctttggtcatgcatttggcaaattgcacaaagtatttggcattaagatgctgaagcgcattcctgaagaggcgaagcaatatgggccaagcatctacatcggtaatcaccagaacaattacgacatggttaccatgtcgaatgccgtacagccccgcactgtaaccgtgggtaaaaaaagcctgctattcattcccttttttggtccgctttactggctgacgggcaatattttgatcaacagagaaaaccgttcaaaagcacacggtacgatttcacaggttgttcaacaaatcaaaaaaaggcatatttctgtctggatgttcccagaaggcacccgcagccgtggccgtggtctgctgcctttcaaaacaggtgcttttcatgcggcgattgcagccggcgtacccatcgtgccagtctgtgtttcttccacacatgatcgcatcaaattcaatcgctggaataatggcactatcattgttgaaatgctgccccccattgatacgacgaaatatactaaagagcaggttcgtcagctggcagagcattgtcgtcaaatgatgcaagccaaaattgaagagctgaataacgaagtcgaagtaatggataagcgcagataatcaaattgctgttggttaggctaatttcataacctattttctcctgctctttgggcggattctggctataaatttaagatagttttagaatttgcactttattcgcgatatgattgcgtttaataaattagcgtttttattaaacgcaatctgtagaaaaatcaaccccaatagcctaaatattgggtaattcatcccaataattatttgaattgtgaagtgcttgcgttcatataagcaatcatttggggattgctattcctgtcgtggagaaaatatgtcactgagtcggcgccaatttatacaggcttctggtttggcaatgtgtttaggtgcgctcccttttgcggttcgggccaataaagatcaacaaacggcactgccgctcccccccttactggaatcccgtggtggccaacccctgtttttagccctgcaaaagacccattggtcttttgatggcaaaaataaggtgcaagtttggggcatcaatgggcgatatttagggccaaccattcgggttcgtaaaggggataacgtcaagctgatatatagcaatcgtttgtctgaacctgtctcaatgactgtaggagggctgttggttcccgggacattggtaggaggctcggcgcgcctgatatcgtcaaatgaaaattggtctccgattatccccattaaccagccggcagcgacttgctggtatcatgccaacacgccaaaccgaatggcacagcatgtttatgccgggcttgcaggtatgtggctggtggaagatgaagacagccgcagcttacctctaccgaaaaattatggcgttgacgattttcctgtcattttgcaggacaagcggttagataattttggtgtacctcagtataacccggcgatcaatcaaggttttcttggcgatacattgcttattaatggtgttgaaaacccttttattgaggttgccagaggctgggtcagattacgtttattgaatgcttccaatgcccgccgatatcaattgcaactcagtgatggccgtcctttctatatggtaggtactgatcagggattattgcctgctcccgtgacggtacagcaattgtcacttgctccaggggaacgccgtgaggttttggtcgatatgtcgaaagtggatagcgtagccattaccgcaggagagtcggcaggcatgcttgatcgtctgaaagggctgtttgagccttcaaccaaattgctgtcaacgaccgtcctgactatcaaggccagtgggctgctttctctcgtgacagatcaattaccgacgcagctagtggtggataccacggaaattaactcatccatccataatcgtcagtttgttttgggggatgcgactcaggggatcaatggggtattgttgaataggaatcgaatcgacatcagcagccagcaaggtgcgtgggagcgctgggttgtcactacttcggctccgcagcctttccatatccaaggggggagattcaaggtcatcagtcataatggaaatcgaccacttccacaagattatggctggaaagatacggtttggattgagggtagaaccgaattgttggtgaatatgatgcagccgtcttatgaggtctttcctttcaagtactacagtcaaatattggaaatggcggatgacggagtggctggccaaatggttgtcactccagccacgagctaaggaaaaaaccaataataataaccaccactgctttgcctgatgttggaataagaaaaatgcctcgaagccctgtcagagcggatggggccattatttcagaaaatcagggtgctcctgatgacgcgatcacttgcttggaacttggtgcatgaacacactatttgttctgaataaattgctaatcttatcgactgagagtagccctttccgtatagtgtccaaaattttcatactatttatttgcctgtaaggtgacttaatgaatatcagcttgattgctgcgatggctatggatcgagttattggtatggaaaatgccatgccgtggactctaccaggtgatttagcctggttcaaacgcaatacactcggaaaaccggttgtgatggggagggtaacttacgaatcgataggacgccctttaccgggacgcttgaatatcgtgataagcagtcagccagcacgtgatgatagcgccacttgggttcgcactatcgaagaggctttggccgcagccggtgatgttgatgaaattatggtgatggggggaggcaaaatttatgagcagtttattcctctggcccaccgtatgtatctgactcacattgatgcggaagtgattggtgacacccatttccccgattacgcacccgatgagtggaattcagtctttaccgaatatcatgatgcagacgagcacaactcacacggctattgctttgaaattctagaacgccgtgaatgagcgccagcagtaaaaaacaatcataaaaacagctgtagtcagcacaactaatcagatttcatctacggagtgtcgtaaggcactccggcgtcacagattttatttcgtggggtcattaacgatttagcagtgatgattggctgaaatactgcttatcttcccaacgcagcattgtcaatttacctccccaacagcagccagtatccagcgcatagatgccgataggcgtacctttgccctccagtgcagcccagtgaccgaatgcaatagaatattcttcagggatgttatgcggcaattcaaaccagggttttagtggggcagagacattttcgggtttcgatttgcagatcatatccaattgaccatttggaaagcagtaacgcattcgtgttagtgcattggtgctataacgcaatctagcaagcccgctcagttcgggatcccagttattgggcatatcaccgtacatggcattgagaaacaaagggtagctgtcactgcggagaatggcttccacttcacgggcacatattctggcggtgtctaaatcccattggggggccaatcctgcatgtgccatgaccagttttagttcatcatcaatctgtagcattggctgctttcttagccaattaatcaaatcatcaacatccggtgctgagagtaatttatctagttggtctttcggcttattacggctgattttagcgtaaacggccagcaaatgaaggtcatggttgcccaagaccagtttaaccgctgggccgagttgcttgatatagcgaagcacctccagcgaatcagggccacgggcgaccagatcgcccgtgagccataacgtatctttgctgggatgaaaagcaatttgttgtaataaagcgcgaaactcatgataacagccgtgaatatcgccaataaggtaggtagccatagttaatttatcagtgttggaatagccagtctgaacacgggaatggcgacacgaaatgggcgaccatcatgatcacgcatttcataatgaccttccattgtgcctaaaggcgtttccagaatagccccgctgctgtagcgataatctgttccaggaaggatcacgggttgttttcctacaaccccttcaccctgaatttctgttcggtgtccatcactgttggttatacgccaataacgactgataagttgcacgggggaatgcccaagattgtgaattgatatcgtataagcaaacacaaaacgctgttgctctggttctgattggctttctacgtaagtactctgtacttgaatatgaattcttggttcgttgagcataaatgcctcctgttactgtaatggctgtttattgatttctggcagtttttgcctgagatgataaccaatttgccatcttacagtattgctcgacagaaatgttttcagcccgtgtgcccggatcaacgcccagttcagacaattgctcaactgaaaagagatcgccaaggctattgcggatagttttgcgccgttggttaaatgcctgagtagtaactcgggctaacatgcgaatgtctttaaccggataaggcatagctttgtacggcataagacgcacaatggctgaatccactttgggggctggcgtaaatgcagtaggtggtacttcaagaacagggataatctgacagtaatattgtgccattacactcaaacgcccgtaggctttactgccaggcccagcgaccagacggttcaccacttctttttgcagcataaaactcatatcagcgatagcatcagtatagctgaaaagatggaacatcaatggtgtagagatgttataaggcaaattaccaaatacacgcagggactgcccctgttccttggccagttggccaaaatcaacggtcatcgcatcctgctgaatgatggtcagcttatcttttagcttaggatgaacatgcaggcgagctgccagatcacggtcaagttcgacgacagtcattttatccatgcgctcacccactggctcggtcagtgcacccagaccagggcctatttccacgacagcctgaccaggctgtgggttcatcgcatcgacaatactttcaatgataaactgatcggttaaaaagttttgcccgaagcgtttacgggcgtagtgcccttgatggactttattattcattactgttttgtatcatcttaattgctaaatttaatgcggtaataaaacttcccacatctgcttggcctgtccctgccagctctagagctgtgccgtgatcgacagacgttcggataaatggcagtccgagagtgacattcacggctctgccaaaaccttgatattttaacacgggtaacccttgatcgtgatacatcgaaagtacggcatcagcatgatccaagtacttaggctggaacagggtatcggccggcagcggcccttctagccagataccttctgccctcaggctgtccaatgcgggaataatcacgtcgatttcttcatgccccatgtgtccaccttcccctgcatgtggattcaggccacaaacatagatatgggggcggcggataccgaatttggttttcagatcatggttgagaatagtgactacttctctcagtgaatcaaacgtaatcgccttgggaacatccataatcggcagatgcgtcgttgccagagccacccgtagctcttctgttgccagcatcatgactacccttgagcattggctgtggtcagcaaaaaactcagtatgcccggtaaaaggaacgcctgcctcgttgatgacacctttgtggaccgggcctgtcaccagtgcagaaaactcgccattcagacaaccctcgcaggcttttgccagcgtttccgtgacataaataccgttttcccggttcaattcaccggcaatgacaggtgaatggagggaaacgggcagaatagtcagggttccggcggcctgtgttggggaaatgtattcaggggagtaaggttgtagttgaaggggcaggttgagttgcttggctcgtgagagcatcaactcaggatcagcacatacaaccagttggataggccactctttttgtgcgagggcaatgactaaatcagggccaaccccggctggttcgccgggggtgataatgatgggtttattgttgtgcatcgctaccatctaaaattttcacataagcggaggcacgcaaatcctgcatccagttttgtgtttcttcaccgagtttacggtttaacagcagacggtaggcattatctttctgtgccgagtccgttctgtcaaccttgcgggtatcaatcagttggattaagtgccagccgaaagtagagtgaacaggctggctgagttcatcttttttgagtttcactaaggcatcacggaaagctggcgcataagtacttggcacattccagcccagttcaccaccacgcatggctgtgcccggatcttcagaatgcttttctgctgctgcgttaaatgtggttttaccacttaagatttcttctctgagtttcatcagagtgctgcgggcttgatcatcggtcataataggtgaagttttcagcagaatatgacgggcattaacttcagtggccgcaaccggcggcatattgctaccgcggatatcattaattttcaggatatggaaaccaacgccggaacggattgggccaataatttgtcccttatgtgctgactggagctgttctgtaaacagagagggtaattcctgcaattttctccaacccatattgccacctttcagggcctgtgtatcgccggaataggtgatggccagcttaccaaaatcggcgccattcttgagttcagataaaatcttgtttatgatcgccgtcgctttttctacctgtgcttgacttggattttctcgcagtggaatcagaatgttgctgacattcaactcggtattctggttattttcgctgctaagattcttggccagcgcctcaacttcctgtgggaggatagtgacgcggcgacgaatttcattattgcgtacttcggcaataaccatctctttgcggatctgattgcggtaggtattaaagttgagaccctcggcagtcagattttttttcaattcatccagacccatatggttctgggcggcaatgtttgagatagtggaatctaagacttgatcggggatagtgatctgcatctgttttgccatttgcaaaatgatgtcatccataatcaaacgctcaaggatctggtgacgcaaggctttttcatccggtatttgctgaccagcatgttttgcactgagtttaacggattgtaattgctcgtcgacatcactttccagtacgacaccattgttgacaacggcagcaaccctattgagttcctgtggtgctgccattgcgacagtattcactgaaaacatcaatccgagaatgagcgctctccagttcttcatacgtttcccatcatatcaatcccgccttggcggggttattgtgtttacattgtgtttgcatcatgtttatcagtatcagaatgcgcgctggtaaggcagaatacctctctccagcatcttctggctacccaaactttgattgctgcttaagccacgaagttcaacattgaatgaccatttgttgtcatattcactgctgttgtccttccagctgacgattttacgttcataaccgacattcaccgcccagcagcaggtgttgtattggaggccaaccagctggcttgccggctgtttctctttggtatcgtaataatatgaacccacgaacgcccagcgatccgccagcggccagcttgccactagcccgacctgcgaaatgccctgctggaatgacggcgcttggcttccaagtgtggcttgaatatagtcgcggttaacaaaacgataattcaactgcaccagacgttctgcatcattgcggtattccactaccgtattgcccattgccacactgttcagacgggtatcgtattgcagaccccctttaaatccccatgaatcattgattttccactcaacatctccggcccatgttgtcgcacccgtactttttttggtgttgaggatatttttgtttgagtctttggagtcagtatcttgggtacgcggactttcaaagtagtagatttgacctacagataggttaaaacgttcaactaaatcttcatcataaatgcgggtggtgatgccactggtaaactgattggcagatgaaatgcgatccagcccactgaagaagcggtctcggaacagcccggaatagttagcctgcaacagggaagaatcgaagttgttaatgttatcttgattcttataaggtacataaaggtactgaacacggggttccagtgtctgagtgtaatccttgttcatatacatggtgcgctcaaacaccatcttcgcatcggatttaaacagtggcaggacacggttgactgtcttctctagcgcagagttctgtatcgtagcaggaacatcttgctgatagtgggttgccatcaatttaaattcattattgaggcttgcccagcgattggagagcggcagattgatagtcggttccacatgccaacgtgttgcctctgggtaatctttgcctacgctggtgaatttggcaacttgggcgtgggttcggaaatcaaacggccccagatcatttttgtagtaattcagatcaagttgaggctctgcacggtaagctttcctatcttttccggcagtaaagatctggaattgcttgcttgccaaggttgcatcccagttctgttgggcatagccaatactgaatttctgggtggcataaccgtcggtactggtgccgtattgcgaggtaaaatcagtgaaatatttggaatcactgactttggtgtaatcagcactgaaacgccatgcttgattgagtacgccactgtggttccaatagaataaccagcggttattgctctcccgatctgacaggtttttatcaagctttttatcatccgcatacaggcggtcatgcccaagccaatcaaaagcgactgtacccgctccggcttttgttaagtaacggaactcgttatccagcttaagaccccgtttactgatcagattcggcgtaatggtggcatcgtaattcggggcaatattccagtaatacggcagcttgaattgcacgccttctttattggaatagctaccattggggatcagaaaaccagaacggcgtttgtcaccaatggggagttgcaggtatgggctgtaaaataccggcacgttggccaccctgaaacgggcattccagatctcagccacttcttctttacggtcgaggatgacttcggagccaacaacactccagctatcgttgcctggcagacatgaggtaaatatcccgttattcataatggtatagcggttttcatcgcgtaccatcaacttatctgcgttaccgcgtccttgacggccaaccatctggtacttgccgtgttccatgtccgtgtctttactgttcaggttag

SEQ ID NO: 16893 - DNA, 72824 bp, Xenorhabdus bovienii
ttgccagatggtttaaagcatcgacggcatcttcattgagcttcaattccactcgacgcagtcctttgactttatctctgcgcaactggttgcgtttattgatcctgagctgctcatccctagacagcggattcgttttcggtcgccctggcctgcgttcatctgcgaacaaatccagtgtggtgcgatcagtttgttcttttgccataaattcaattgtaaagggcgtggccaatagtatagcgggcaatgataccttagctgggcgcgagccgctactggttgatgggggagatggttggcaggaagagagagatatgggggagtgggttgggtaagcaatcaataggtgtacgtgatcttgctcaccgtccatctcaataatgtcacattcgagctttgtggctgctgaagtgaaagcctcccgtagttgttcaatcatgcatccatcaaaaagtgtccggcgatactttgtcgtgaatatcaaatggacaactagcttgctgacactgtgtcgttttcggagaaaaccgtcgagccattcattatgctgactcaattgaaatattcctgtcgcctgttactatcattgaactctatcaatgagcgctgactatgttaagagccacaaaggtacgcatttaccccacactcgaacaggctgaatatcttaatgcccagttcggtgcggttcgttttgcgtacaataaggctctgcacataaaaaaacatgtctacaaacgtgatggggtgagtttaagcccacgtaaagatcttaagccgttgctggcgacggcgaaaaaatcccgcaaatactcgtggctcaaggcgtatgattccatcgcgttacagcaggcggtcatcaatttaaatacggcttttgataacttcttcaatccaaagttgcgggcaaaattccctgtctttaagcgcaaacacggaaaacaatccagttatcactgtgttggcgtgaaggtgttgaatgaggcaataaaaattcccaagttgactccgatagaagcgcgtatccatcgtgaaatcaacggtgaagttaaaagcattaccctatcgcgaacacccacaggaaaatactttgcctcaattctctgtaaagatggcaaagaacctcccgttcctcctgatgtgatcgatgcagacaaaagcaccggatgtgaccttgggttaacccacttcctcatctgttctgatggtcggaaacaggccaatccccgctatttaatccgtgccagtaaaaacctgcggcgcaagcaaaaagcgctctcccgaaaacgaaaaggcagtaaaaatcggggtaaagcacgtttaattgttgcccggtgccatgaaaaagtggccaatgcccgtggggattttcagcacaaattgtcccgacaactcattgacgaaaaccaagcggtgatagtcgagacactgaaaacaacccatatgctcaaaaaccgcagactggctcgtcatattgctgatgcgggctggcacagctttgtgacgaagctagaatacaaagccaaagaagcggggaaacatctggtcaggcttgacccgtggtatgcgagttcgaaaacctgccattgttgcggtcaccaagaatcggaaatgcccttaagccagcggtactgggtatgtgcagtgtgccagacggagcatgacagagatatcaatgcggcgttgaatatccagcagcaaggcctatttgaattacaggcggcgggtctcgtcgtctctgcccatggaggccagcgtcagacttgtcacggacaagccgcggcctgtgaagtgggaagcctcgcccgatagggcggggagcagtcacatatggtcattactaaggaaatagccggacagccaaccaacaccaataataataacatcctactcattgattcattgcactgggttgcatcaaaagctatatatttcaatgaatttcaagaaattcctcttgttattttttctgaaggttgtgttatccgcgaatgtgctataaaaacgttggagaatgtagataaaccgtatttctttgtgtacgtaagctcctcatttgaaaacataaaaagtgcagtagaacacggattaggggttagcctattgccactcagagcactaaccaatgatttgtatgtattatcctccgaacatggcgtacctagtgttccagcaattaagcttgttttacatattgcagctcaaggggatttatatgaattctttgctgattatctacgccgctcattatcagaatagtatccagaatttcagtttgtgtaaattcgaaaaggaattctcattccttcggtaaaaatagaataactaaaacttttgtgttaggtgtttagttctaatatttgatggattaggatttatctctaaaatagccttttaaattaaataattaattcgtttggcttatttaacccggaataactattttgttttaatatgaaaaacacctacataaaattaaaacaaaaaagaagaaggtacaataagtacttgatgttagtgttattgatgacaatattttccgagccttctgattaaggcgccggccttaatcagaaaacaggtacggatattatgacgtaaaaatttttcttatcatgtaggtaaaagaacccatgctctcaagccacttaaaattcggctctaccaactctctccctatcgcacccccggcggttatcattagccaggatgccgtctgttccgcattaatctgtttatcaatttcccctgtttcaatccccttacggattaatagcgctaaacgttccctgacttttttttcattttcgataaatatcttattaattgtagggttacggctagcttcagcgataatttcgatgctgagtcgtgcataatcgggttggttatacaggtggatcaggcttgtcatcatcttttctattgttgccataaccgagttttcatcatcattggtatgcaaaatttcgttatagtcatggctgtcttcttctgcgatagcttcaataatggcgtttttggttgggtaatagtgaaaaagattacctggactcatgcctgctgccttgcagatttctgctgtggatgttgcatgaaatcctttctctataaaacaggagatggcagcatcaatgatttgtttgcgtttagcgcgctgtttttctgtctgttttgacaaaacatattcctccaaaagatcggatataaaaaattagattaattactctatctaatgttcggatgttattatacagactaaatgtttattcttcttatttaatcgtcagaaatagttttatgagtattacactcataaaaatgcttaaatgttatttatgtccggctgttaatttgcacaaaaacatgccggacataaaataatctgtcagtgataatcgagatcgtctttcgttactgaggtaaatttcttaaggtgtggagtaataaagtttttaaaatcatccatataactgtaaataaccggtacaaacagtaaactgagtaaagttgaactgagtagtcccccaataaccgagattgccatcggcgcccggaaactggcatccgcgccgctggtaatgaccagcgggatcatgccggcaatcatggcaatcgttgtcattataataggcctgacacgctctctgcctgcctgaataatggcttcatttcgtggcataccgttgcgggatttttcgagaataaattcaaccaataatattgaattttttgagactatgcccatcaacattaatatgccgataataacgggcagatcaatggcggcaccataaataagcaatgcgataatcgcaccaccgatagcaaatggcagcgcaattaaaatcgtcattggctgtaaaaaatctttgaacagaataataagaatagccagcaccatcatgatactgagcatgatggtcgtcgtgaaacgatcaaacatttcattcatatattcaacttcaccatactcgactcttttgacctccggcggcaattttttcattgtcggtaattcattgacttgcataaacgctgtgccaaccgcaataccattaagatctgcatcaatactcgctttacgctgtctggcaattcgttctattttgtcagggcctgaggcaaaagagatatttgccaccgatttcacaggaacattgacgttcgatgtgctattcacgtacagatcatttaatacggtcagattatccctgtcttctttggataataagacgcggatcgggacttgcctatctggtaagttaaacttagcgactctggaattgatttcacctattgttgccgttctaatcacagtgccaattgcatcggttgtcacgccagctttggctgctgtatcaacattaggcgttatgataatttcccgtcttggcaagggttgcaagagctggatattcttcaatccctccaactgcatcatctcttgacgtaactgttttattgtctgagacaaaatttttgggttttcactggccagaacaatcgaaatatctcggctgccactactattgccaaagttatatcgaatatctggaatctcatttaagataggaaccaatgattgctcaaattctttttgtgaccagtcacgttcacccgtaggtactaagtttataataatgttacttttattctggctaatctcgccagaggagccatcaacgccagcaacagaaaaaatatcgataatttctgggcggccttgcagttttttaataatcttctgcaacgtttcatcactttgcgctgcttgggttccgggtggtgcttcaacttctattgtggtgatactgatatccgctttaggcataaaacctgatggtaacagtgctaccagggctaatgatcccaaaagaaagacgatggctagcagcaacgctgttttgcggaattttaatgttttttccaggatagaaagatatttctttatccatttcggtgtctctgttttatccgttttctggtgttttttaggctgtagcagataggcggacatcagtggagtcaccaatctggcgaccagtaatgatgataatactgccgctgatacggtaatgccgaaggggacaaaatatttaccgataaaaccaccaataaaactgacgggcagaaaaacagcgacaatggtaatagtaatcgcgactattgcaaaccctattgcatctgaagctttgatagcggcaatataaggtctttcacctctttcaatatatttttctatattctctatttcgacgatcgcatcatcaactaaaatacctatcaccaatgttaatgctaataaagtgatactattcagagtgtaaccaaataaatgtaggataaaaaatgccggtagtatagataatggcaatgcaatggctgcaatcaatgtcgctcgccagcttttgagaaagaaaaataccacaatgacagttaatactgcgccttctatcagtgtctgcatggttgcattataacttgccaccgtatattttacatttgatgaaacaagtttaatattgacatccggatactctcttccagtctcctgtaatgcccgtacaacccctttttctacctctgtatcacttgaacctttagcgcggaatacggcgaaacccacaacaggttcatcatttaagcgggcaatggtgatggtttctttatgtgaatctctgaccgtggcaatatcgcccagttttatccaattatcgtttgctaaaggaagttttaattggcgtaaataatctatttcattctttgcacctaaaatacgaatagtatgatcttgtcctgcgacgaccatttttccgccaggaatattgacgttattttgaagtaataactggttaatatccgcaacactgatcttcaatgcagccatctttaccggatcaggttcaatcaaaatttccttattggttccacccagccttgttattttctgaacgcctggcaccattaataactttttacttaatttgtcatcaacaaaccaagataattcagtcaaattcttatcttttgactgaactgcgtaattcagtatagcactaccctctacatcaatacggcttatcagcggttcatctattgattggggtaattccgaacgaatctgtgtaatctgctcccggatatcatttgtggcaacatgcggatcaattttcaaatcaaactcgataatcgtgatggatacgccatccgttatcgttgagttaatatgtcgaatgcccggcaatccagaaactgcgcgttctatgggttgtgtaactgcattttccaattcggaaggcgatgagccattttgtgtgacagtcacagtcacaaccggaaaattaataacggggtttgcattgataggtaatttcaaaaaggaaaataacccagcgacagtgagtgccagaaaaataacaatcgtgggaataggttttctgatagcccattcggataactgatatttcatcttattttccctgtggcataatggcaacagtatccatttcttgtaggaatggagatgcagaaacaatgattttatcttttggcgataagccggattttatctcaatccagttatcaaaaatacgccctgtattaatttcttttttctctacggcattatttttaccgacaacatagacactcggtttattttcatttcccatattgacagcactataaggaatggcgttgactttttctggtttaagctgaaataaggcatggccgaaatcccccagtttgacatcggcggggacattttcgagcgcaattcttatttttcctatttgggtaacgggattaattttcggcgagatatatctcactttaccggttattttgctgccggaagtgagagaaatagccgcaggtattcctgtgtttatttgttttaaatcagaaatataggcttcagccgagaattcgtgcaggttattttcgatcagtttaaacagttgactgctatcggttatcatacctgccatcgcagttcgttcactgataacgccttctttgggtgcaaatatggttgttttcgcccgctgggttttttccccttctaattgtgcctgtaactgccgatattctgcttttgccgcatttaaggcggataaggatgaatttgcctgcattttgtatttgtcaaattcactggcagaaatgacccctgtatttaccagcggttttgcacgattaagttcggactgtgcctgattactcgtcgcttcattctgttttatcaaagccagcgctttttccagttccgctttggcttgtttgactttttcatcctgaaccagtgtttctaatgtagctaacacatcaccttttttgacatagtcgccttcttcaaccaacacttctgtgatgatatgctgagggagcgccgggcttatcacaatctcattttttgctactactgatcccaatattttgacagagggagtgaactgtacagcctgcatggtcgtggttgacacatgcatctgctcttggggtgactgggcatttgtactgaaaatgaacatggaaaaacaaacgccaagaagagatagaagatttcttgccattcctcgtccttacagtgatcacttaagttagtgttgaggttttagatagattagtctatctaaaaaattcgtgcaacagtgatgtatcagcagaaattctcagcctacgccagaccatgggactgacaccacgaacagcgagtttaactgtgtacattttcatagcggcaaagctgtcggttctgtcgcattaacgtaatatcaggtaagctctcctgtttttgaatgagtccagagtgatgttcctgatccgaaacgcgttcaaacgccgccattatcccgtcgatatcattgcccaatgtgtccgtgggtatctgacctacgtgctgagcttacgcaatctggaggaaatgagggcagaacgggggatcttcgtcgaccacgccacatcgctgggtgttacgtctggtacccctgctcagcaaggctttccggaaacgcaaaaagcctgttggctcccgatggcgaatggatgaaacgtacattaaagtcaaaggccagtggaaatacctttaccggtcggttgataccgacgggcagaccattgatttcctgctgacggctaggcgggatgccgaggcggctctacgctttttctgtaaagcgatacgccagtacggcagaccgactgtggtgactattttgttttctttagcaaaaactttgctcgtgccttaagcactttagttcccttcttaaacgaatctcgggttgattatttacggaatgcaatgctagcccacagaaaaacttccactatggtgatatttttggcgatactcttttggcgtcagaccattgcagcgtttgaataactccctgaaataacgggtatcttcgtaaccgacttcatggctgatttcttcgatggttttctgagatttttccagccagtgcttggcctgtgacagacgtatctgctggatatactggatgggggtttttccggtggcgattttgaagcgccgtttcatttgtcgttcacaaaggtggattttgttggctaagtcggctacggataaaatttcggaaggtgaggtgtgcatccaatcttgtagtttgtggatgagagaatctgaatgttgacgataaggggcaaaactgacggaatcagacgaaattttggggtcattttcgccaaacaagaattgtgaacattgttctctggcatattgtccgtaaatcaactcaacaatactcatcatacttttgctgcacccataggcgctggaaatgcagaaacggttattgtcacgggtgatttttttgtcggcatacaggggaatatggggaaatagatctttgaattcgcgggaaaaatgagggtggattgttgcgctggttttcagtaacccggctttggcaaggatgaatgtgcctgagcagactgaaacgataggaatgtgcttttcatccatcgccttgagccactctattatttccggtgagcagtattgcggctgccataccgggaaacccagggagccaaccagaataatatcgggttgttggccatgatagagatcggaatgggaagtcggggcgggttcagtcaacaggctattggttccgttcatttcctggcttgctggcgagataatgcggacatggggaatggggccgccaatggcattggcggcgatggtgagtatttcaatcggcatagcaaccgatgtcaccgaggtgtgagaaaataccagggctgtgatagataattgtttcatagttatattctcttccttaagaacattttgttatgttgtgttaatttcgttacgaaattaattttaagctgaaacaagtctcatgtcttcaatgaattttctatcgtgatagtcactctgtttgttgatgccaaagttgtgcatacagtccgttttgttgcaataggtcatcatgggagcccgattcgacgattgttccttgatctaaaacaaaaattttatccgcatggcggatcgtattcagccgatgggcaatgctgatgaccgtccggttgcggcggatttcgtccagattgctcataatggctgcctcagattcataatccagcgcggaagtcgcttcatccagaatcaggattttgggatcattcaataaggctcttgccaatgcgatacgctgccgttgcccgccggaaaggttgcttcctttctccccgacaggatgggcaaatttatgcggaaattcattgatgaagtcagttgcacccgccaaggtcgccgctcggtagacttcttcatcgctggcactgggtttgcacagacggatattgtccgcaatgctgccggaaaacagaatgctttcctgcaataccacgctcatgttacgtcggagtgatacgggatcggcgatcgccaaatccataccatcgaccagaacctgaccatgctgcggcacatacagacgctgtaacaaccgggtcagggtacttttacctgaacccgatggccccgttatgccgataaattcgcctgctttgatggtcagtgacagatttgccagtacttcgggcgtatctgtgtgatagcggaagcgaatattcctgaactcaatctggccggcaagttcaggggaagctgccagcccctgtttgctactctccattggctcatcaagaatatcgccgacccgtcgcaaagcgatcaaagtatgctggaaatcctgccagacttgcgccagccgtaagatcggctgggtgacgtgtcctgccagcatattgaaggcaattaactctccgggggataattcgccgttaagaacgcttctgaccccccaccatagcagtaatgccgctacgactttctggatcaaagcgatcccctgtccggccgcaagcccacttttctgggcggaaaaacgtcggatcaattgctggcttaacactttttgccactggtacagaaagcgtttttccgttgccgtggtcttgatagtttcgatgcccatgacggattccgtcaggaaactggtggcatgggcatcggcttcatattcggtttctaccttgcgtcggatgagaggcccgatggcgatccaaagcaggaaatagagtgccagtgaactgattacgatccaggtcagcagagtggaataatggaacatgacgccaaggaacaggatgatgaagatcaggtcgagcagcaacatcagggtggagccggtcaggaattggcggatttgtgccatttctctgacgcgcgcgataatttgtccggtttggcgttgcttgaaatagggcaggggcaatcccaccagatggcggtaaagcctgccggagagttccgcgttgatctggcttgccatatgtccgaacacggtattgcgcagaaaaccgtacaagggttctgctacggctagcgccagcatcgccagaccaagaacatgcaggctggataagctgcgtccgaccagtactttgtcgatgacattttcaaacagcaaaggagatgccagcgcaaaaagttgcagcacaatggcgaacaggaaaatatcccgcaactgatttttctgcctgaaaatcgaaggataaaaccagctcaaaccgaatttaacttgctgtttggtcagaaatttatctgccaccagcaggattttatactcactgtgtttagcttcttcaggtgtcgtctgtgtgccgtgcaatgggcgtatttcttgtttttccgtgatgggattgagcacggtaaactggtctgggctgacctcgagcagcacccaccagcactgatctaattcaatcagtgccggtaaaggcaacgtggctgcggtatcggctgtcagacgatcaaatttgctgtgcaggccgatggcatcgatagcctcgcgtagctgccagtctgtcagcgtcagggaatccagacccagcgcatgatgcaattgtctgacggaggcgaccttatgaaattgtgttcccagataggcgacacaatccagtgcgtgattattggtgagatcatccgtgcctgcatcactcgtaaaggaaaatgcgtcaaccatgattatttttccctcaacgcttcagactgatattcctgaatcggactgagcaggtaatcaatcacccgtcgttggtcggtcttgatttctgcggtgatggacatcccggcggtgatttcgacaggcttaccatcaacgatgatattgttctgtctgaggctgatttgcgctggaaaaaccagacccaggcgctcatcggtcgtggaatcccgtgaaatactgagcagttcgccttcgatggtgccatagcgggtataagggaaggcatccactttaaccgtcacatgctggccggggcggacaaacccgacatctttattcaggatctggatttccgcgagttgcacatggtcatccggtacaatcaccatcaaattctgtgcaggctgtaaaaccgcgccgagggtatggacgctcaattgctgaaccgtacctgccacaggggaacgcacgatctcaagggcttctcgttcctgcatttttgaaagctcttgtttcagcacgcccagttgcatctctgcctgcttttttttctcaaaccattcccgctctttttgcgtgttgatcccctttaaccgctcttccaggctcttgtattgggtcatcaagatgcctagttctgctttttgttgagtgattatccgttgtgtttccagcaattctttttcttgttccagatattccactcggctaatcacctgcttctggctcaatatttttcgtgcctgcaagcgctgattgatattttcacgcaggttggtcagagcctgaatatccccgtttttggctttttgagaagagagattgacgtccatttcagcataaagattggtgataatggcatcgaattcatgcttttcgtgctcgtaatgcgcctggattttttcttgttgggagagagtctgctgctgaaagagaggcagtgattcgggatcatgtttcccgagcagtgcctgatagcggattttctcttcgatcagatattcacgttgttcaagcaggcgtgtaacgtcctgattaacgccgagcgtattcagcgtaagcagaggggcatttttttcaatgtgctgcccattttgaatatgaatagagagcagacggctttgttcataagcctgaatgatttgggaacggccggaagctatcagacgcccggtggcggttgcctgtacatccaattttcccagatacgcccataacagtaccaccagtaccccgatactcaaggtgatcgccgtataacgggcaaacggggaaggaggacgttgtgacaaggccagatgtgtgggtaaaaaatcataatcgggcgaaggagtacgtaggtttttaatccctttgcgtaagatggccttaaacatgggaagtcacctcctgtttcagttcctgttgcaattgccagagttttcgatactgcttgccctgctgtagcagttgttcatggctaccttgttcaataatttgaccttggtgcagcacaatgattcggtcgcattggcgtaccgtggagagtcgatgggcgatggtaatgacagttctgccctgcgcaatgtttgccatattggattgaataatcgattgtgactcatcatccagtgcgctggtggcttcatcaaggatcagaatggtgggatcagacagcagggttctggcaatggctagacgctgtcgctgcccaccggagagggattggccgccttctgcgatgatggtgtcgtaccccatcggcagcttgagaataaaatcgtgtgcacccgccagcctggccgcttcaataatatcagacagaggagcatcgggtcgtgattgggcaatgttttcatgtacggttttattaaacagaaaattttcttgtaacacgatgcctatttgctgtctcagagattcaatattgaactcttgcaatggaatgccatccagtgtgatggtgccatgttccggggtataaagccgaagtaacaggcgcgcgagggtactttttccagaaccggatgttcctactacgccaagcgtttctcctgcccgaatatccagcgtaaaacggttgatggttggggagagatcgggctgatagcgaaatacgatatcagagaatgaaatagcaccctgcaatgagactcgctctttgcctgactgctgctctgtcggcaggttcaacatatcccccagtttatcaatggcaatgcgtgaacggataaattgcccccagagttgcactaacttggctaggggttgctgggtatggcttaccatcatattgaacgcgatcaactggccgatggtcatgtgcagggagagtacttcggaggcaccaagccagataatgaccgcactggtgactttttgtaacagcatcacaagatggctggagcggttatcccattgctgcacatcataactggtactcaccatattctcggtctggctatcccagcgccggataaagcggggttccgctgcaaggcttttcagtgtctcggcaccggcgacggtttcggtcaggaaagaggtattgatcgcagcatgagtgaattgcttttcgacggctttctcgattttgggcgtgacccaccatgccagcaggccatagaaagggatggtagccaaaaacagcaaagtcagagtgccggatagcaggctcatcacgtaaataaatacgaacatgaacaggacatcaatacacagggtgaacatggaaccggttaaaaactctcgtacggtttcgagttcacgtacccgcgtcacaattgctcccacttggcggaatttgaaaaacagcaaaggcagaccaagcaggtgccgaaccagctttaaccccagtttgatatcaatgcgattggctgtatgggcatactgatattcgcgtagcccacgcagaaccacttcaatcaggctcgcaaccaccagaccaaaaatcaacacatctaaggtagataacgcctgatgaacgagtaccttgtccatgacaacctgcacgaccagaggagaaatcaacgctaaaatctgcaaaatgaacgaaaacagcagaatttcagtcagatttttcctttgtcggataaattcgggaataaaccagcggatattaaattggttacttttttgttttatttttatccagcgtccgctccataaacggataaagttttctttatccaatatctcaggcgcttcctgattaggtttttgaatcaacactcgctgttcatcatgttttgctaaaataaagggatgcccattaccatcgaacagaatagcgggtaaagataacgtgtttaatttcttatttattgaacgtttatttttaatagaaatatgatgttctttctttaatttatttaaagtaaaaagataatcatcattattatttatgtttttatcgggtataacgatgggcttgccattagatatcattattattaatttaattaatgatattgttgttttttctatttcattcataggggtaaatttattttaataaaaaccaaaacccaaattaaggaaagaaccagaagaagagtatggtatttctttataagataatcttaataaatacgataaaaggtattatctgttatcaatgaggatatcagggttggtaattaggacaaaatgtggtggttaaacagacatttttatttttatatgttgattttaaaaagtaaatagatatatttttattcacgcagtcgataaattatttggtttctaatagcctattttatttgccattttgagtttgggcagcgttcaaaatctgcgtgtactcattcttaattttttaacaaatgttgtgttcatgttatttttgtctggtatttcctattcaagttgatcgcaacaatgagatttaatgataaataaaaccataacgacatagggttttaatcatttaatttaatataattgtaacattaagtttaaatttaatatatttgcaacattaaatttaaacttatttaatggataatgatatgtctgaaaaattcgttcaaaccatttcaagtgttaattataataaaggcgtgttctctctttattttgttggacaagagcccaaccgaatggcaaatggcatactggctgaaaacgatcaggaattacaattaaagcaagtgattcacatgcctgcatccggctttatgtatatggtttccatggtgaaaagtatgcttgaagaccctcggatggaagccgaaatgaataagctgatcgcagcagggttcttgcctgtacctgaaatgagtgaaggtgaaatgccagccgagccggaaacggctgttgcagagaccgttgagcctaaaaaacgcccagcccgcgacgcggaaaaatcaaaataatatcaggtatcagtaaaatcatatcagatggttgctagcttatgatgatcacacatcaacccgcaacgctgagtgacactgaaatacaggcaatgataggtggggtgatgttgctttgtcagcattcacccttacaccgacgctatttagttgctgagtggcaacagcgtatctttccttcattccagctcaatcagttttgctattacgaagatgaacaccaacgcccagttgcattttgtaattgggcttttttgtctgatagcagtcgggatgcgatcctttccggtgaacgggagatttcgcaggaagactggcgttcaggacaacatatcttttttccggaaatgattgccccttttgggcatgcgaagggtatcgcccgtgatcttcgccggcgtgtctttgcagcatggaaggggcaaaaagcctgtactgtccggggaatgctggacacacaaaatgaccactgtatccgtcgggtacagtggtttaccgtttaatttttctgcccaataccaggattacttatgggaaaatcatccaaccgaagtgcggcatatgcctttaccggtaaatatgaagatgataatgatggaaatacaatacacgccatcggcattggcggcgtcattaacgcctatggcgggaatgatcacattgtagtgggttccgttggtgcaacagtcaatacgacatgggggcacgatactgtcgtgggggcggccgggtatctggatattaacgatacgagcggtactctgacggtaaaaggaggctcaggttatacctccatcaataaaacaagcgatggcacgatagattttgctggcgctgccggtggactgaaaatcaatcacacaggtgataaaggtcgaatcgattattctggcgcgtctggctacaatggcatcacccgcaagggattggaaggaaatttcacttttaagggcgcaggggcgtataacgaactctggcatgaaaccaatcagggaaatttctattttgccggcgcggggggtggaaacaagattgatcgcacatggttcaaccgttatcaggggtctaacggtgatctgacctttgaaggcatcggtgcggcaaacatcatcagctccagagtcgaaagtggtgatattttttttgcgggcgcaggagcggctaacaatcttgtccgcagaggaaaaattggcaacgtcactttaacgggcgcaggggcttctaaccgtattgaacgtacccgccagacggatgatgtctattctgaaaccagaggcgatatcaagttcgaaggcgctggcggttataacagcctgtactctgatgttgcgcacggtgatatccgttttgcaggagtggggggctataaccagattacccgcaagggcacagcccatgacttcgataacgaaggcatggaatatgccaaagccgaagacattgtgttgaaaaatgcgaccctgagtggtaagtggattggctacaacgagcaggtgacgggtcttaaatcggcacaggaagcgaacacttatctgtttgcgtttgctgatggcatgtataccaaagtcaacaaagttcagctccgtaatgatcctgaaaccggcaaactgatctatcactcgacggcttggtacaagaatgggaaccatcttaaagaccttgagaagcaggatatctctggtgaaggtggttttgcgggcgtcaatattgacggtgcttacaccctgtcaaatctgaccgttgaacaccagcaatctgttaccgtccatgctgttgaggaaaaactggctgaagaccaatggatgaatcatggcgatggcgtgctggttaatgtagcagatgtcacattgtcaaatgctaaaatgggtggctatgcgattgacagtaagggaggcaccgccgatgtacaggtggtgaaatccaaccataaatcgaacacttatatctatgccaagcgaatcgataaatataccaaaattgtggttattgaactgaggaacgatccaaaaacaggcatgctgcaatataacgcacaggcttggctcagtttggaagatcgcatggcgaaactggcgaacgaagatatttcttctgctaatggctatcaagccgtgccggcgggtatctatactctgagcgatcttcattacagtgctaaggcagtacgtacagcttcagggcgcgtatctggcatgcacgaatacagtgatctggcgttattcaaagcgccgacgagcagcggtaaaagttccggtgatgttcactatacaggcgcaggtggcggtaacgttatccactccaacgttacccgtggcaatgtctactttaatggggcaggcatcgccaatgtgattgaacatacttctgagtttggtaacacggaatttaatggcggcggatcggcgaacgtcatagtcaaaaaaggcaaagaaggcaacctgactttcaacggtgtcggaattgccaacgtcatactgcatcaagggttgcgtggtgacatggacgtgaatgccggaggagcggccaatatactggttcgcgtcggtgatggccgctatctcgctcatcttttggcggtcggcaatatctccattcacaagggcaacggcaacagccgcatttcaatgggcggtggtttcaatacccacacccaaatcggtcatggcgacgcattctggtctggtgtcggtggcttcaatgtcttgactcaaatggggaaaggtcatgtttcctccattctgctgggcggtgctaacgtcctgaccaaagtcggtgaaggcgatcttgaatccgccatgttaggcggcgccaacatcattacccatatcagcaattatcgtgaaacgtccaacacgaaagccatcgcactgggtggtgccaatgtcctgactaaaaagggcaagggagacgtattgtctgtcatgggcggcggtgccaacgtgctgacccatgttggggatggcaaaaccaccggtatcctgctgggcggcgtgaacattctgaccaaagtcggcaacggcgataccacgggcatcatgttgggtcttggtaacattctgactcatgtcggcaatgggcagacgctgggcgtgatggcggcggcgggtaacattttcaccaaagtgggcgaggggacaaccatcgcggctatggtgggggcaggtaacattttcactcacgttggtcagggaaatgcctgggcactgatggggggtatcgggaatattttcaccaaagttggcgatggtgacgcactggcattaatgctggctgccggcaatgtgttcacgcacgttggtgatggtatgagcgtggctttgatggttgccaaaggcaacattgcgactaaagtcggtcatggtgaagtgctttctgccatgattggcgagggcaatatccttacccagattggtaacggtgacacctttgccgccatgctgggtaaggcgaacattctgactaaagtcggcaatggtctgacagccgggctgatggtgagtgaagccaacatttatacccatgtgggtgatggaaccagcatcggcctgtttgtgggttctgtcaacgtgatgaccaaagtgggtaatggaaccacccttgcggccatgtttggcaaagctaatatcatgacgcatgtcggcgacggtttgactggtgtccttgcattgggcaaagccaacatcatgacaaaagtcggcaacgatttcatgggggttgttgcggcttctgaggctaacgtggtgacccatgttggtgatggtactacagcagccgtgctgcttggtaaaggcaacgtgttgaccaaagtgggtgacggaaccaccgtgggtttactgatttctaaaatcggcaatgtcatgacccatctgggtgatggaaccaccatcgggttcgccaagggtgaagccaacatcatgaccaagttgggtgatgggttgggaatcaatgccgtttggggcaaggccaacatcatgacccatattggcgagggtgatcgttataactttgccaaaggtgaagcgaatatcatcactaaagtgggtgatggccaggaagttaccgtagtgcaaggtcaagccaacattgtgactcatgtgggcaagggcgatgattacacgggtgcttggggcaaggccaacgtgatcaccaaagtgggtgacggacgtaatgtcgtacttgccaaaggcgatgccaatattgtgacccagattggtaatggagacagtttcaatgcactgtggagtcagggcaatgttgttaccaaagtgggtgatggcatgcaagtcacggcagccaaaggtaagggcaacatcacgacgactgtaggcaatggcctgagtgttaccaccgttcacggtgatttgaatgtcaataccaaagtgggtgatggcgtttccgtcaatgtggcctggggcaaactcaacgtcaatacccgagtgggtgatggcctgaatgtttccgtcatgaaaggtcaggcaaatgccaatatccgtgtgggtgacggcttaaacattaacgcctcttatgcacgcaataacgtggtgattcaggtgggtaatggcgatttttatagtcttgccgttgcggaaagtaataccgagagcaataagctgggtgccttatttgacaacgtgaagcagacactgcttggcgtggcgggcagtaagggtattagctatctggttaatggcgacgaagccaacacatcgggaactcataagggacgcggtgccattaatctgcccgaagtttccgcgctgaatggtttccagttgactgaaatggagcaggtcaaatctgatttgcagaatagcctgaaaggttcggtgacgggcgttgataccccggacactgacagtatccagaataccttgggcaatgaaaaacggttgagctctaatcagtcgcgcaatctcattgtcaatggagactttgagcagggcgcagacggctggcaatccaccaatggtattgaagcctattatgctgcacagtcctatggcctcagtaatgagggtcatggcgaacgtgttagtgagctcgatgcttatacccatgctgataaggattctaataccagtatttatcaggatattagtgatctcacggtgggcgaatccatcacgctgagttttgattttgcaaaacgcgccgatatttctgctgacaacggtatggaagtactgtggaacggaaaaaccgtattctcaatttccgcaggtaacgcggaatggcagaataaaacattgtcattaaccgcacaggagggcagcaaccggctggagtttaaaggcacaggcacaaatgatggtctgggctacattctggataatgtcgttgccaaatctgagctgccagacagtgccattgctggccatgtgcagcaggacgccgccgcacagaatgcgttacaggataaagaaaaagcagaagcggatcgccagcgtttggaacaggaaagggatacacaactggccgccgtttctggctctcgagcgcaattagaagccacggatctggaggctttgaatgggaatggacaagaccagtgcgatgcaataaataatgaagccgaagctgttaccgaagaattggcggagaaagtcaaagggctggcaacactggatagctacggcaagcatcatgggaaatccggtgaacagtggcgtgctcaatttgcgggtggtttgttaggacaggttcagacacaactgaatcgtgcaaacgacacagcacagcagcagttggatcgctcacagcacgcggcttcagaacgtttcggtgatctcagggacgcggtggccaaatcagaagccggagtcagcaaaggcgagcaacaccagcagcagtctcagaaagagattgaacagacccgcaccaatgccgaattcaggaagcagcaagccttaagccaaaagaaacaggctgaacacgctgaaagtgacgctaaggccgcagtgcagaaagccgaacagcgtggtcaacatgaagtttctgaggcaggcagccaaactgcacgggtgcaatctgatgtcaaagccgcaaaacagagtgataactacaaaccgaaccacgcgggtgcagcaggcagtggcttgtcaggcactgcctatgagtcccatgccgctgaaaaccagcctgagcggataaaaacggataatcctatcggttttgcaccgaaagatgagacaaataccgggttcagtaaggaattacaatatctggatgaagacctcgacgagctgactgaggcaaaagcagcattgaatcgcttacagatcaatgcagcaaaacgcggtaaaagtaccggggctaccctgatatcggcttatacagaaacgtctgccagtcagcctgtcagcaagaccgcagatgtgcctaccgaatgggtcagaaacacgccgaaaatttccggtctggatctcagtggcctgcaagcgctgggtgaaacccatgttcagcagggatctactgatgcacccgaagcgcctgccactgccataagagcacaaaaagttgcagatgtttaccgttggctggacagtgacaacaatattgccacagatacctatattccggtgcctgggtttgatcgcggtgatgctgatattcccgataacatcagacagaggttggtgacctttgttgagggataccttgaggggactgacaataatgtgccgaaagagcaagtcgctccgctggcgaaactgttcgttgatgccacgattgattgtaactgggataagcgtgtcgaattcgtctctaagctggaacaatatggctatagttttgagcctgtccatggtgataaaagcatcgtgtcgttctggtctggcaaaaacttcaagcaataccgcaatgttcttgatgccgtgcagaccgacggcaagaaagtggtctacgatattgatgtgaaaggcaactcttttgccatcgaactgaacaaaaccctgatgcgttggggcaacgtatatctcgattctgacaatgccgaacataacgcattacaaacggccattaatgcttcggcacggagcaacaccgggttctggagctccctctatgccaccggatctcgtgatgacgtgtatgtcattgcagaagggggattgcgtcttggcaactatttctggaatgttgaactgccggtactacgtcaattgcagcgtgaagggctggtgggcgaaatccgtctgctggataaacctgcccgtgaatatcagggcgcagcacctgaaactattggccgcaggctgacggaagccggcgtttctgtgaaggcacgttttgattctctcagcattggagaacaggaaagactacttacgctgaatccggcagggtataagcccgatacactgattgatctcgacataaaactgagcgccatcgacaacatgttgaatcaggcattgccattctacggactgcggacagagcgcaacctgctggtacgtgaagctgatgatgaaggctttgaagtgcgccggtggccgggtcatgacggtgatgatttcaagacgatcatggtggaagatgcggaagatccggctcagatcaaggctattgagcgtttcatcctcgccaactacgacgattacggaaaactgccggatgccttgtatttggtggcagaccagattgtttcccacgagcaggggcgtacccgtatcgtggctaaaaaagtggatggcagttggaactacaagccgaagactgacttgatgtctgtcagtgagtttaaggatgcggcttccgttaagggtaaaatccttggtgacagttaccgcaacgtactggaagcgctcggcagttacgaaaaagccctgcaaaacggtgcagactatgacttggatgccgtggaaaaactcatcagcctgcaccagcaagttgaaggctatctattagggcatcctgattcaaaacgcttacccgccatgacaaacctgctatcacaaatcaatgtgcgcatggaagaatcgcgggtactggcggaacctacgctgacaagtacgggcaagggcagtttcagtgagttgtataacaaactcggcaatgccaatctcaaagattcgaagcatctttatattgatgaacagggtgattttgttacccgtggtaaatccaatattcagctagtgatgaaagcggaagagacggaaaaagcggtcaggcagatcaaagtagctgtcaccagagaatatggtcaggaagtggcagaaaccgtcttctcaaacctgaaaccccaagatttgtcgaaagatggcaacggcatcgatgtgtctggcttgagaaaggtgcatcaggcaattgaacagcaactgtctccggtcagtgccactctgtttgtctggaaaccgagcgatcacagccgactgggacatgccgccctgcaaattgggcaaggacgtattcaggttagcgcagaagatgccggaggcttcaatgagaaaaactatgtgagctggtggccgaaaggcggtaaatcgaccagtcctggacacatttttaatgtttccacggcagaaaatccagacgtgaggttacgttggcgtgatctcagccagccggcttctcagaatgagacgctgaaatttgatgtcggctctgaagaaggggataactttggcttgaaggatggtacatacaagctggagaaatttattgaaaaactacaggctgccaaaggcgttgatgcaaaattcgaggatatcagcgagggctttgccatgtctgcgctggctaaccctaacctgcttaaatcagccggtatacctgagcatatttcccgaccgtttatcgaacaatgggaaaatggcaacattgacatgcaggacattggccgagattttgccgaagcactgcggacagccgcgaaacagaaaatcacgcctgagctaactgaaaaacgcatcactaatatcgttcgtcagtttgccgaacgtgaattgagcgacattcaggatttcaaggccagcgaagccgatcagggacgtgtattccgcatcaatctggcaggcttggatgccgcggcaatgcaggcagaatggaacaaaattagccagaaccctgatgcccgctatcaaatattgaacggtaactgttcaagtatcgtagccaaagtgctcaaggcaggtggagccgataaagtgatcggtcatacatggcggccaaactttggtatctggaccccaaccgaattattcaattatgcgcagaaactgcaagaagcgcagattgagagaatagccaataagccgaaacgcattgttggtgaagatctggaagcgctgaaccagcaggctaaaaaagacaacgtgctggaaaaagttgccattgacaacgacggcaaaccaccgcgtgacagagaacccttcaatccagtaacccgcttcctgaacaatgagctttacggcgctaaggaagatcgccgcaatgtgcatggttacactcaaacggcgctggacacggctgtgaccaacggcacggcggataaagtcacgttacggggcgacgctgggcgtctgaccggctattaccatcagggcgaacagaagcctgatgtagcaaccgaaccgaatgcagcgaaaaaagtagtcctgttcattcatggttctggctcctctgcggaagaacaagccagtgtcatccagaaccaataccagaaacagggtatcgatatgctcgcggtgaacatgcgaggttatggttccagtgatggtcgtccgagcgaaaaagggctgtatcatgatgcccgcacgatgttccgttatttggtcaatgatcgtggcgtcaggccggaaaatatcattattcatggctattctatgggtgggccaattgcggctaatcttgcccgttatgccgaacggaacggacaaaccgtttctggcttgctgctcgatagaccaatgccaagtatgaccaaagcgattactgctcacgaagtgccaaacccagcaggaatgacgggcgtactggcaaaatcggtcaatggccagttctcagtagagaaaaacctgcaggggatctcgaagcaaaccccaatcatgttgctgaccgataatgaaggtttgggtgaagcgggagaaaaactgcgcgctaaactggttattgatggctatcaggtatcgggtgaacataccttctatggtcatgaggccagcagccgcttgatgaaccaatatgctgaacagattgtgacaggtttgtttgatgtgaagcgtcagccggatgaatcaacggcacttaaaggtatcaagagtgatctgaagcgctatggtgaagcgctggaacctcagaaaggtgcaccgggtaaaacgaaagatatccgtgcgacgcaagacttccttaccggttatcagcaagggcatgcagagcagaccgttgatggtttccgttcagacatgaacatcaaacaactggtggatctgctggttaaaggtaactggacagcagaacaaaaaggctcactggcttgggaaattgagagcagagccttgaagattaccttccagcctcaggctgagaagcataatcggctgttcaatgacgttgtttcggccggggttgctgacaccaaggcgaacaagcatcttgcaccacaattactgttattgaacctgtcgaatgacggttttggcgggcgttgtgacccattgtcaaaactggttctggttgcgaaacagctggaaaacaatggtcaggatggcgttgcccgtaaactgttggaaaaaatgtattctgcggctgcagtacttagcaatctagagctgtattcagacactgaacgcggcaatgccagtaaattattgggttctctggctgctcttcatgcccggaacccgatgcatgacacttctatgaaggtgtggcaggagaagctggaaggtaagcaggccttgaccgtcaatggcgtgattgggaaagtgactgccgcaaatgcggatggcaaacccgttctgcttgagttggatgcaccaggccatgcgatggctgcatgggcgaaaggcagtggtgagaatcgcgtttatggtttctacgatccgaacgcaggtattgtcgaattttcgtctgcggagaaatttggtgattaccttactcgcttcttcggcaaatctggcctgaacatggagcaaagctacaaactgccaaaaaatgacgcgggtgaaattaccttcaaccgtgtagttgtgatggatggcagcgtactggcaacttacagcccgacacgggctgacaagaccaccatgcagggtatccttgatctgaatatctttgatgagacgccaataaaagcccattcaggtgtggaaattacccatgaggtgaaagtaccactcaaggacaatctcccggaaggcgttgaccgtgtggttaacaacgagaatgtcgaatattgggaaccggcttttgtcaaaccgcaggcagaagggggtgacagtcgctttaacggtcaggtcatcatccagacggaaaatgatcccgtcgcggccaaggctgccgcacgcttggccggtaagcacccagactccagtgtgattgtgcaacttgatgctaatggtcaatatcgggtggtgtatggtgatcctgcgacgctgtctggcaaactgcgctggcagatcgtcggacatgggcgtgatgaatcagtacagaatcacactcgcatgagtggctacagtgccgatgaacttgcgttgaaactgaaacagttccgtaccgacttcaagcaggccggctcgcctgatcatatcagtcttgtcggctgctctttgatcagcgatgacaaacgcgatggctttgcccgtcactttatttcagagttggataagcagggcatccgaaccacagtatcggcacgcagcagtgaagttgcggtagacagcattggccgtaaattcacgcgcaatgccgaagaacagtgggttcacaaactcgtggataacaagattgtactgggctggaatgacaagggagagctggaaacccacgctgaacggatccgcaggggtatctctgaaagcgacattaacttgtcccgtatcggtcacatggatactgatgtgaaagcgaaaggtgcgattgcagaaaatacagaaacattccacgccccggaacagcacaagaaggtgaatgatgattcatcggccacgtcaccggcgaagtcatccaacaataaactgagctattccggcaatattcaggtacaagcgggtgatggcgaatttaccgctatcaactggggaacgaccaacgtcggtatcaaagtcggtacaggtggcttcaagtcactggcctttggtgataacaacgtcatggttcacatgggtcacggtgacagcaaacacagcgtcaatattgccggttatcaggcactggaaggtgcgcaattctttatgggtaaccggaacgtcagcttcaataaggggcgtagcaacgatctgatcgtgatgatggataaatccattccaacccctccgttgatcaatccatttgatggggcttcccgtatttctggtgtcttgcagggcattgccggctcctttgattcaccagattggctgagcgcccaagatcagcagtggacactggagagcgcgaaaaaatacgtcagcgacctgtcaggtctcgatctgaccagcagtgtcgattacaacacgctgaccgatctcgatgcggagaatgaacgaagcagtcgtggcctgaaaagtgatatcgaaaccacactgaacaagaaatacaatcagtggttgggcaggaagggtaatactcgtgaaatgggcaacgtcagtcgggcggataaattccgtcaggcgaatgaaaaactggcctttaacttcgccgttggcgggcagggtgccgatattcaggtaacgacgggtaactggaactttatgtttggtgacaatatccaatcgatcttggataccaacttgggttcactgtttggcctgatgacacaggaatacacgtccacgggtatggctaaaaccacgtttactttcagcccgacggacttaccacgtcagcttaaaaacaagctgctcggcaatctggcgggtgtcagtgcagatacgacactggcagatatctttggtgttgattacaccgcagatggtcatattgtttcccgttccaatcaatcggttgatggcgttgcgattctgcgtgaaatgctggaagtgatcggtgaattcagtggcgatcaactacaggcatttactgatccggcaaaactgctcgacagcttggaagccgggctgaatatgggggcagatggagttaaatcttttgcggaaagccacggcctgaaagcaaaagcgcctgatgaaaacaaagagggacatgtatcaatcagtgaaaagggtaaacctgttcaggaagctgaagaattaccgtcagatcgtgcctttggctttaacctgccaagcctgttcaccaccttgttcaagcaggataagcaggttgagatggcatcactggtcgctgatctgaaagagaatctgaccgccgatttgctgaatatgcaggacaaaatgtttgacttcctgcgtaacagcggccatctgcaaggtgacggtgatatgcatgtctctctcggcaactacaactttaactggggcggagacggcaaagaccttggcgcttatctgggggataacaacaacttctggggcggtcgtggtgatgacgtctattactccgtaggaacctccaatatcttcaccggtggtgaaggtaatgatatgggtgtcctgatggggcgtgagaacatgatgtttggtggtgcgggcaatgatgttgccgtactggccgggcgcattaactacgcctacatgggggacggtgatgatcaggtctttgtcttcggtgaaggcggtgtgattgatggcggcaaagggcgcgattatatcgtggcttccggtaacttcaataacatccattcaggagaagggcaggattatgttgttgccattggtaacaacaatcaggtgggtttgggagcaggcaacgattttgccaccgtattcggcaactataacaacattgatggcaacgccggcaataacgcgatcaaactgatgggttatcacgcggagatcaatggcggtacgggcgacgatcatctgattgccgatgtggtctccaagttcagccaattgaacggcggcgatggcgatgacctgctggttctgggcgggtaccaaaaccacttcaagggtggcacgggcgtcaatagctttgtggtcagcggggcggtgattgacaacgtggttgaagatatcaaacgcggcgacaagatcattttcaacaaccccaactggcaaaagctgtggttccagcgcagcggttacgatctggttctgctgactggccgtgatgtgacagacacctcggcacaagggaagtttgaggcgatgggttctgtgaccttcaacgattacttcaatggcaaccgtgcggatattgtcacccaaatgggagacaaagatgcacagggtgaacgtgaatatacggcactctctgccaattcggtggattcgttggttcaggcgatgagcgggtttgcgccaaatatgggcgacaccggctttattgatacacttgatagtcagacgaaatcgactattttgaccgcttgggcggacaccacaagcggaaaatccaaactggcctaatggccggaaagggtttttaagcagtaatcttcattaaatataatggctcacgaaagtgggccatttcagactgttttatttattcttaaaattaatggaggatatttattaaaattgacacataaatccaacttcccaactattgttctggtgattatcccagaatccgggaggatagcgctcaatatcactttccattatcatcggttttcgccattcaaaatgttttaatcccgctttattggcggcattttcataatcttcatgactccagcaatagaaaataagagggcttggaggattggtgataaattccgcttcatggcggaacccgcttttccacggagtttcgctgataaacttaacctgatagttactgtagtcatgattatccaattgaaagtctggttcaatttcattgattaacttaagatgtgtcttttatttccattatcgagccctttttttaataaatgggggtagattcacataatgctctgcaataggcttataggaagaatcttttattttcattagccaaatctctattaaataatttggctatttggttgcttgctatgcaagctaaatataatgggaaaatcccccgtaattttacggaggattattttgttaaagttgacaaacaagcgctgtatcaagacagttacgttgataatcatcccaaaaacccgggggttgcttctcaatatcacgttcctgcaacatgggtttatgccattcaaaatgttttaaacccgcttcattgattgcagcagcatactgttcgcggctccagcgatacattgtaaaagggctgggaggagtggtagtgaattcagctttcaaaagcgttgtatcttttacaggttcttcactaagaacttttatgaaataattttcatagttccctttttctagccgataatcaggttcgaatgtataagctatgagtttgccggaaggtttaagatggtcggcaacaacacggaacatcgttttaaggtcttcaaatgactcggcgtgacaaaataaccaggctgcaacgatgagatcaaatttcccaaatgattccatcttgcagacatttctaatatgaaattctatgtcatcttgatattgccgtgatttatttttggctatttgtatcattttatctgatatgtcaacaccaataacgtttgaagcgccaagttttttgaatttacgactaaaaagaccatatccacatgctaaatccaacacggactttccttgtacttcacctgccagatgcatgatagtccgaatttccacgtcgatatgaggacttgagtctgaaaaattttcgtagagatgtgcaataggattatataagatattatctgtcattatttgttctccttaattacattcaaggtgttatttctttctatgggatttgttatttagtattgatgtaatatttgatgatggtttctctgttgtatatgttaaagtgacaataaagaattttatataattatttttgttgattaccattaaattaacgactataaaataaaaatattaggtgaggtgataatgattggaggcatagatgcaaagaaatcttgaaatatgtcatctgttattcgagtgataaatatttaatttattattataattctggagcgcctaaaataggatttcctgatatgattccagttttacgcctggaaatttatatttggtgaagaagattatgaagctgtaaatattaattattatgaaatgatatcaatgtttgatatattctagtgagatatttatttttatataaaattaattatctttaaaaataaacattgaatctacatagaaatttagtggatttaacgttaacattagtaatgtcaataaatttagcgtgtaatttcaatatgataataggtaaatttaatatactaaaaatagaattaatgataaagatgagcctatttaatatatattttttacttggttttttatagtaagtgaaatattattatgctgaaaatgaataattaatgggttcatgtcgaatctgaaaagagaggaaattaaatgtcaaagggatattttttaacagtcagcgataaaacaacttgtggtggtgaaattcttacgggaaccagcaacattaaattttatgggcggcaggctgcaattgaaggctccacagttacctgtgggagatactcaggaaattatgtcattgtgggaggagtcggttcttttttagataaaggagcgaaactggcagggactttggatagtcaaagtacttgtccctgtaacgctagtcttatttgctccattcctgatagctatcagaaatagagcaatttctctggcttaccctactgagggaaatctattttatcgcgtattttttgatttttttggagaaatcataaataaattgctatagttagcgaaatttcactagtatcatttgttaaaacaattttttattgggggaatactcaagttaaatggacaatgttcattcgagattaaagagtcggacattgtcctaattaaccatttagcaagctattttgataaaactagtacacagtaggactaataatatcggtcagttgcgggtttgattcttctgccactatcagtgacataactgtcgaaaatcttgatgtaactatcagcaaaaatataaaaggaatcttgtacaccctctttcagtattgccatgacaaaaccgcgctcatcagtgcgatcccatgattcacggctgccaggtgataccgtaaaccgacccgtttgtccatcatcgccccatttattaacagaaactatgatattactttgtgtattatttattatcttcatgattcctcctgtagtgatttatttaatataatatatttacccatattgttatattaagattaaatttatgtttttaaatatattgttactgatttataataaatttaattggtttttgtgattcatgcaataataataaaaaacaatatcatgatatgaataatatgataattatcatataaaaatatttaattttattaatatttggattggttgattgtatttatttttattattgtgttatataaataattatcatttaataattttattatgtgataactatttttcattatacgctattgttaagttatcgtttaatttatgtgtagatgaagttaaataatctattttctataaaaatataaagtgattattttatttgttactgttttttaattaaactaaataatttttattatatatactttgatgttctatctactatatgaaaatagataattgtctgattttttatgattgtttttatataatgcgacaggagtatttatctatggaattctatctaaatagagttgttagattttttattgcattatttattttattattatcatctttcgttctaaatgcttttgctggaaatgaagcaccttatgcacagtatataaaaaagacaaattttgttattccctgacatcaaaagggaatttgattttattatcagtccacatagcgtgtggactgatactgtaattatttttttgctaaaaaacgatgaattgccctgagtaccgcttcaggtttttccgcatgtacccagtgaccgcaacccgctataacccatgctgtcgcctgaggaaattggcgcatgatatcttcgcggtaggcttcggtaatgtaatccgaatttccgccacgaataaacagcgctggtttgggccatgcaggaatcgcttcccagccgataattttttcatattctttttgcaaaaccggtaggttgaatttccattctccttgacggaatgatttcagcagaaattgaatcacgccatcctcatgaatatccttccgcataatttccgtcgcagcctgccgagtctgagcacctgcttccgtgacttggtttagtgcagcaaaaatgctgtcgtgatggcgagtcaggtaagtcactggcgctatatcgataaccacgatttgttcaatacgctccggcgcaaccgccgtgatggtcatggcaattttacctcccattgaatgcccgataataatggcttttgccacattcagctcatcaaggagagataaaacatcttgtgccatatcgcggtaatccatgttttccatctgcggagaaataccgtggttacgcacatcaatctgaatgaccggataatgttgctgcaaatcacgccccaatatccccaaattgctcaaatcgccaaaaagcccatgaatcaagacaatgggggttgatgactgtgggttttccggcgtgtgaaaatgataatttaattgattatttgagttcatagtctgcctgaatttaatgtcattgatacaacgtttaatatcgtgatgtttaataccatgacaggtcggcagtgacaaactaaatggcataaaatgactgtaactggttgatttattttaggggaaaagacaagttttttttgtttcttaatttcagaaagaatcactttaagttattgaaagtttaattgttttgttttgctgtattatatcttataatctcagaataattttttcattaagaacagtactggatagaaatgaaaacgatagaagttgatgaagacctttaccgctttattgcaagccaaaccctgcatatcggtgaaagtgcatctgatattttgcggcgcatattgaaagtggacgccgggcagccagtacaaactacaccgcctgccagagaatctgtctctgtcagcaaagtgccggctgcacgctcccgtgatgttgttcgcattgttcgtgaattattgctttctgacgagtatgctgaaaagaaaaaatccgttgagcgtttcatgtcgatcctgtccactctgtacagcttgaacagcgaaagctttgcgaaaacaacagaagccatgcatggccgtacccgtacctattttgcgggagatgagcaaactctactggccagtggtaatcacactaagccacgtcatatccctggcacacctttctgggttatcactaataccaataccgaccgtaaacgcagcatggttgaacacgttatgcaggatatgaaatttccggcaaatgtgattgaaaaagtgtgtggcactatttaactgaactcgatcagttaactgatttaaaccgctgaattgattaaactgcactggcgaataagccagtgtagcctttcaggagaaataaagtggcaactcatccaagagcggggcagcctgcccagcagcatgatttaatcaatattgcacagctcacatcccagtattacaccctacagccccatcccgaaaatccggctcatcaggtcaaatttggcacttccggtcatcgtggcagttctggccgcaacagctttaatgaagcgcatattctggcaatttctcaggcgatagtggaagtccgtgcacagcaggggattactggcccatgctatgtaggcaaagatacccacgcactgtctgaagcagctttcatttctgtgctggaagtcctgaccgcgaatggtgtggaggtgattgtgcaggaaaataatggttttacaccgactcctgctatttcccacgctattttgtgctacaaccgtcaggggaaaaaccgggcggatgggattgtgattacgccatcccataacccgccagaagacggcggtattaaatataatcctcctaatggcgggcctgccgatactgatttaacttcaatcattgaaaagcgtgccaacgcattgctggcgaatgacctgaatggggttaagcgtctgccttatgagcgggtactgaagagtgaatatctgcatccacaggatttggttgatccttatgtgacatccttgggggatgttgtggatatggcggccatacagcaggcagggttgaaaatcggtattgatccgttgggtggttcaggtattgcttactggcagcggatcggtgagtactacaatctcgatttaacgctggtcaatgataaggtcgatcagacattccgttttatgacgctggatcatgacggtgtgatccgcatggactgttcatcacgctgggcgatggcgggtctgctggaactgcgcggtaagtttgatttagcctttgctaatgaccctgattacgaccgccacgggattatcactccagccggtttgatgaatcccaaccattatctggcaacggctgtggattatttattccgtcaccgtccacaatggtctgaaaaagttgctgtgggcaaaactttagtttccagtgccatgatcgatcgcgtagtcgcggatctgggacgcgagctgctggaagtgcctgtcggttttaaatggtttgtcgatgggttatatcgaggcgagctgggctttggtggtgaagagagtgctggcgcctccttcctgcgttttgacggtacgccgtggtcaacggataaagacggtattatcctctgcctgttagcggcggaaatgacggcgactaccggagagaatccgcagcagcgctatgacaaactgggtgcacgtttcggtacgccaagttatagccgtattcaggctccggcgagccatcagcagaaagccttgctgtccaaactgtcaccggaaatggtcaaggcgaacacactggccggcgatcccatcactgcacgcctgactaccgcttccggtaatggtgcttctattggtggcttaaaggtgatgagcgacaacggctggtttgcggctcgtccttcaggtacggaagaagcctacaaaatttactgtgaaagtttcctcggcgcagaacatcgcgagaagattgagcaggaagcgctggaaattgtcaatcaggtgtttaccgccggttgattgattatctgaagagattataaaagccgtagcaatagactgttgctgcggctttttgcttccggcgagtggggttatcccaaagcgaccattaaagcccccgcagtaatcaatgccacacccgcagcacttgtatcatagtaattatggtggttagctaccatcataagaaacaaggtgagcctcatattgcacatttaagcgagactttgttaataagcgaaggccccttgtttcaccttccacgccagcaccaatattgaacggtaaccaagagcaacgactctgtatatacaagtgaaattggcgtgatggcatcaaataagaggagggttattatgtattatgtcggaatagatgtcagtaagaataaactggatatttgtttgttatatgatggagttaaaggtaaacgcaaaacaaaatcccttctgaataatgaacattcagcctgtatgttaatagcgtggctagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctgctaaaatccgtgctaagttgtttatgtctgcactcactgcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttgaccatcaagacggtagcttattagtgaaattttctcaccaaataggatcacggccaggatcaccgcaaatacgacactcagtttatcgatgggagcgacttgggaaacatgaccctgtttgatcgccagaaaataaaatagccaggaaagcgcgcctgcaatgccacttaacaagataaacagcagtgccttgcgattgaccagaatttcgccgataagattcaattttccttgaacgacgacaacgcctaccagaaacagagccatgataacggctcggattgctgttgctgtattggcatccagattttgtagaccgattttgccaaaaatagcgaccagcgctgccgtgagtgcagatagcagggcataaatcaaccatgtgctcatattcaatcaatcccattggtaacagcaagggagtgcatgatattcccattattaatacagattcaagaaaatacgatgcccatttttacctactctttttagtttcattataaaatagtcattacatttattatcacgatattgtgacagaaataactccgcctattttctcctccctccctttacaacccaaggaggatgcctaatcgtttgaggcagcatttaatatctaatctcattttttcaaccctaaaatagtcgatgctctcttgctattaaaaggtctggctatggaatctcacttttggaaaaaggcttacctgatcctattaagcagtttattttttctactactcactagctgtgataacaaaaataatttacccaaaatcaccgaggaaccgatggcttatatcccgaataacatacctgctaaagtcaccactgctgacgatcttcaggcttcagcacattgggtcgataaacggacactattatggccagagggagcagataagcctcatgtccgtttatattacaaccgacataacaaggtagagccgaatgatgaaggaaactttactgatagttatctggtgctgacaccgacgactctaagcaaaaagacagccgaaagattccctcatttagcggcgctgcctgcattccaattgccagagaacacggatgttgatcggttgattaccggtgatctggtagcattggcgaccaatgaagaaggcttgttattatcggcaactcaagtacaaattgctggtgtgctggacgaccgctttgccggcaccgcagaaacactagagtatggcgcactgataaacgacacggaagtgactttccgcctgtgggcgccgacggctcaaaatgtggatctggttatttataatgaagataaacaggccatcgccaatcatacaatgaatcgcgatgcggagagtggctcttggtcatggcagggtgatacgaatttgatcggggcttactaccgctatgctttaaccgtgtatcatccgtattcccgcaaggtggaacgctatgaggttaccgatccctattctcatagcctgtctacgaattcggaatatagccaggtcatcaatctggatgacgaagcactgaagccacaaaactgggatgacctgagcatgccgcatccgcagaagacatcggcagatattgcgcgtatggccctctatgaagcgcatatccgggatctctccgttgcggacagcacagtaccacaagcttggcgtggtaagtatctggctctcacggctaacagcagcgatatgttcaaacacctaaaggcattgagtcaggccggaatgactcatatagagctgttgcccgtgtttgatatcgcttctattaatgaatttagtcataacgtggttgatcttaatcagcccttcaatcggttatgtcaagtcaacacaacggtgaaaaatagccgcttcgctgattattgcaaccgttccctgaccgtgagggaagtattgcaggcgttacaacgcggtgacagtgccagcaatccgcaagtacaagagttaaacgaaatgattgcagaaaccgactcctataactggggctacgatccgttccattactcagtaccggaaggctcttatgccactcatgcagaaggctcagtgcgtattaaagagtttcgtgccatggttcaggccatcaagcagcaactggggatgaatgtgatcatggatgtcgcgtataaccatactaatgccgctggccctgcacatcgaacttcggtgctggataaagtcgtgccttggtattaccaccgtttggatgaaattacgggcaatgttgaaaataatacctgttgctctgataccgcacccgaacaccggatgttctccaagcttatcgaagactcattagtgacttgggttaagcactataagatagatgcgttccgctttgatttaatgggctaccatcctaaggctcagattgtctcggcgctggcaaaagtccgcacaattaatccctcggtctattttttcggtgagggttggaattccgggcaggacgatcggttcgaaacggcttcacagattaatcttaaaggctctggtattggtactttctcggatcgattgcgggattcggtacgcggtggcgggccgtttgattctgctgataatattcgtattaatcagggaatgggtaacggtgcaggaacattacctaacgaaattgccgtattagatgcgaatgaagctcgtcatttggcggatctggtccgtcttgggatggcgggtaatctggctgactttgtcatgatcgataaagatgggaaagtgaaagcgggtcgggaaattaactacaaaggtgtcgctgcgggttatgccgctgatcccattgaagtgattaattatgtctctaagcacgataatcagacattatgggacatcatcagctacaaagctgcttatcaggcggatctggcgacaaggcttcgtatgcaggccatttctctttccacagtactcctcgggcaagggctggctttcgatcagcaagggtcggaattactacgctcaaaatcgtttactcgtgattcttataatgcaggcgattggtttaaccgtgtcagttataactacaaagataacaactatgatgttggtatgccggggaaacgggatgacggtgataattatgcactgattcatagagtgaaaaatcaggtgaaaaaaccaggccaaagtgagttattacagatgatggttttctatcaggaactgttacgtctgcgtcaattttcacctttgatgacccttggtaagggggaatcagtcaagcaacgtatcgattttcgtaatgtggggccacatcagcaactcggattactggtcatgaccattgatgacggcaacactaccgatgatgatcgtgatttgcggtttgatggtttagtggtggtgattaatgctgcgtcaaaacccgtcacggtgagagatctcaatactcatggtttgaaattaaatgatattcaaagcagattagggaatgcatctttagctgccggaatcaaaataaccgaagatggcatggtgacaatgccagcttggtcagcagcggtgctggttttaccacagaagggtatccgaggtacgggtttacctgtccgtagaaaataacaggaaactttatcagggcatcagggcataaatcgataacccacaccagtctctgtcagtaaatgcttgggacgggcagggtcttcttccagtttttgccgcagatgccccatgtatatccgcaggtaatggctatgctcgacataatgcggcccccagacgtgattgagcaaatagcgttgggtcagcactttgccgctgttggtcagcaattcggtcagcagacgatattccgtcggcgtaagatgaagctccttctggccttttaagacccgacgattgattaagtcaacactgatatcggcaaaatgaatcaccggatcgggctgattggctttggtggcacggcgcagggcgactctgactctggcaagcagttcgttgataccaaaaggtttgctcagatagtcgtcagcgccgccatccagcgccgctactttatcctgctcattatcgcgtgcggaaagcacaatgatcggaatgctgctccattggcggatatcatggatcagatcaatgccattaccatcgggcaatcccaagtcaaggatcagcaaatcgggtttgcgggtggcggcttcaattaaaccgcgtttcagtgtgtcacattcaaatacgcgccagttttcgccttccagagccaatctgacgaaacgtctgatctctttttcatcttcaacgatcaagatcgtactgtttttggttatgctcacgtttcctcaatgatttcttcaattttgggcgcctcatctaacggtagaacaaagtggaaactggctccaccttttttattgttagttgcccatatacggccgccgtgaatttcaatgatggcacggcaaatcgctagccctaatcccacaccgggaatggcggattctttacgggcgcgtgagaatttgtcgaaaatgaattgttcttgtccttgtggaataccggagcctgcatcccaaatttcaatatgtacctgtttgtgttcggtggttgctcgtatgcctaatggtgtctgttcatgggtatatttaatggcgttttccagcaaattaatgaagactcgttccagtaaggatgcgtcacaatgcaataataaattggctggcagggaaagttctaccgtgtagcggctgagggtatattctaatgagcgcagggtactaccgacaatttcctccagtgactgccattcaagattaagttgaataccgccggattgaatacgtgccatgtccagcaggttattgaccaaacgtgaggtgctgaggatctgttgacgaatttggttaacctgttgggtatgaggcgaattttcagtggataaatctagcatcagtatctctgtctgcccaaacagaaccgtcaacggagtgcgtaaatcgtgggaaagtgcggccagtagtgaatttcgcaattgctcccgttcggtctctagcttggcggattccgcacgacgggaaaggtgcaaacgttccagggcgttggcgataagcccggtgaacgtttgtaataaccgctgttgttccggtactaataattggcgcaagttaggcgattcgatagcaaggacagcaaatacctgtgaagccgtggcgataggaaatagctgatagggtacgccgggtaatgtgtcggttcctgcccctgcaggctgtttcttgtcaaaactccatttagctatcgcctcatcgatctgcatttgtccgccgttattggatttcacctgatataaacgtgcgtcgctatccggcagcagcaagcccgtttttgcctgaaagctgttggacaaaaagtgatagctgatacgggcaacgtcttcttcattcaaggcacggctgagttcacgcgtgatttcatataagtgccgcgttcgctgttcacggtagcgggccactctggcttgatagcgtatacctgcggtcaagtttcccacgactactcccacgatcaacatcacggtaaaggtaagcagatattgcatgtctgtgacggccagtgaccattgcggctggacaaaaaagatgtcgaaactgatgacattgataaaggcggcaaagacagaaggccagcggccataaaacagggcaataataacgacgccgagcaggtagagtgttaccagattggctttatcaagggtgagtaaaaaggtatgggagaacagggtgattaaggtgcagagtataatcgccatgaggaagccgtgaatctggacgcgccatttttcatggaatgcccggttatctcgttgctctttatcccagcgttttttgtcttccagcgcaacaatgatgagatcgagatcaggccccagttttcctaaacgttcaacgaaatcagagcgccatttaaaaccaaaccatttatcactaaatgaattcaaatgtgagccataatagcggccaacaaggattttgccgagattgtgctctcttgcataacgcagaatagctctttcttcatgaggatcggaaagcgtggcagtttcagctcccagctcctgtgccagcttcaatgctttcaagatggtacgccgcttgatttctggcagccggtgtaatttgggggtttcaacgtaaacggcatgccatttacaactcagttttgccgccagacgagccgcggttcggatcagcttttcattgcctgcattacagccaatgcacagcaacaggttatcccgtgtgtgccagacaggttcttttccccgtgtatcacggaaagcacgcatctgatcatcaacacggtctgccgtgcggcgcaatgctaactcacgcagcgcgatcaagtttcctttgcggaagaaatgctcaatagcccgttcggcctgaccggaaatatagactttgccgtcgttaagccgctggcgcagatcatccggtggaatatcaaccagcacgacgtcatcggcatgatcaaatatgtgatcgggaatggtttcgcgaacacgaatgcccgtaatggcgccgaccacatcgttcaggctttccagatgttgcacgttgatggtggtcaggacatcgatacctgcttccagcaactcttccacatcttgccaacgtttgggatgacggctgctgtgaggattgctgaaggccagttcgtccatcaggataatggcaggatgacgggcaatggccgcatcaatgtcaaatgcggcaattctgcgctcatgatagcgaatatgctttggtggcaattggggtaagcctgtcagcagtgctgcggtttcttgtcgttcatgggtttcgacaacaccggcaataacatccagcccctgagacagcagccgctgcgcttcctgtaacatggcataggttttacctactcctgcacaggctccgaaaaatatttttagtttgccacggggtttttcgtttgccagtgtcagcaagtcatccggattggggcgcaggggttcaatctgatccatatattatcagccttgtgatttcaggttatccagtgccagattaagctccagtacatttaccacgggttcacccatatattccagtggaggatatgcagtatgcgcttgaatcaatttgttaatcacatttatggataagtggcgggcagtggcgacacgttgtgcctgaaattcagccgcattgggggaaatatggggatctaaaccactgccggatgcggtgatgagatcgacaggaatggcgttgttttctgaatgattgaataaacgtacctgagtaacccgctggtgtatttggtgagtcaaggcgggattggttgtcgagaggttacttcctccagatgacagggcattgtaaggctgttccgacgtcatagacggacgtccatgaaaatagatggcttgggtaaatgactgaccgattaattctgaaccaaccagtttgccattgtgttcaatcaacgcacctttggcctgatggggaaataaggcgtttgctatgcccgttatcagcaacggataggcgatgccagtgattaaagtcaggaatgtcagtaggacgatggaagcgcgtaacccaatcattttaatctccttatttgaaagccagaatagtgagcaatatgtcgatgagcttgataccgataaaggggacgatcagtccaccaaggccgtatacccaaagattccggcgcaggagtgacagtgcgttcatcgcgcggtaactgacgccttttagcgccaaaggaagcagaacgataatgattatcgcgttgaaaataacggcagacaacaccgccgattccggcgaatgaagatgaatgatgttcagggcattaagctggggataagtgaccgcaaatgcagcgggaatgatggcaaaatatttagcaatgtcattagcgatgctaaatgtggtcaaggagccacgggtcatcagcatctgtttgccgatatgcaccacttcaatcaatttggtgggattggagtccaaatccaccatatttccagcctcttttgcggcttgtgtccctgaattcatagcaacggcaacatccgcctgagccagcgcgggggcgtcgtttgtgccgtcaccggtcatggcaaccagacacccttcagactgatattgtcggatcagggcgagcttcgcttcgggcgtggcttctgccagaaaatcatcaacaccggcttctgctgcaattgcagcggcggttaggtgattgtcacctgtgatcatcaccgttttgatccccattctgcgcatttcactgaaacgctctttgatgccgcctttcacaatatctttcagagcgaccacacccaaaacacgctgattctccgcaacgaccaatggcgttgcacctttactggcgacctgctgcaccaatagatcaatggcatcgggaaattgattgtgattggcctcaacataacggcggatggcatctactgcgcctttgcggatcatgcggttgcctatattgacgccgctcatacgtgtcatggctgagaaaggaatgaatgtcgcgttgagtgcgcgcagatcgcgctcgcgcatattgaagcgctgttttgccaaaatcatgatgctgcgtccttccggtgttttgtcagcgagtgaggaaagttgcgcagcatcggccagttgttcttcagttacgcccggtgcaggtaaaaactgggatgcctgacgattaccgagagtaatggttcccgtcttatccagcaacaaaacgtccacatcgccggcagcttcaatcgcgcgtccactggtggcaatgacattggcgcccaacatgcggctcatacccgcaacgccaatggctgaaagtaatccgccgatggtggtggggattaggcagactaacagggcaaccagcacggtgatgctgatgggatcgcctgattgattggtttgaacgctgaacaaggaaaagggcagtaggctgatacaggccagcaggaaaataatagtcagcgcagtgagcaaaatagtgagagcaatttcgttgggagttttgcgtcgtttggcaccttcaaccatcgaaatcattctgtccaaaaaggtttcgcccggattgacagaacattcgataatcagccaatccgataaaacccgtgtcccgccagtgactgaagcaaaatcaccgccagattcgcggatcacgggagccgattctcctgtaatggcgctttcatcaacggaagcacccccttcaagaacttcaccatcacaggggataatttcgcccacttccaccagcacaatatcgcccttgcgtagatggtctgaagtgactttttcctttgctgcatcacggctagcggaagctaatcgggtcgcccacgtagttttttttacgcctttcagactggacgcctgggcttggctacggccttctgccagtgcttcggcaaaattagcgaaaagtacagtgaaccataaccataaggcaatggagccggtaaagagtgcattaccggtgagctgttccgttaacatccccagccacaacacggtggtcaggcagcttcccagatagacgacaaacatgacgggattacgccattggatagcgggatggcattttttcactgcgtcgataagtgcatggcgtattaaagcgggctcaaataatgcttgttgtttgtctttcatgagttatctcgcaatctcgcttatcgtggtgcttgccaaagttgtaaatgttctgcgacagggccaagcgccagcgcaggaataaaggtgagtgcacccatcagcaaaaccaccagaatcagtaatccagtgaatagagagccgtgagtcggcagtgttccactactgatagtctggcgtttcttgctaatcatggagccagcgatggccagaactggcaaaatcacaccaaagcgtcctagaaacatgattgcccccaacagcaggttataaaacatactgttggcattcagaccagcaaatgcactgccgttgttattggcagcggatgagagagcataaagcacttcagtgaacccgtgggcgctggggttcatgatcgcaacgcgtcctgcatcgattgaagttgccagagcggttcctaacaggacaagggagggcgtaaccaaaattgccagcgcgaccattttcatgtcatggacatcgattttcttgcccaagtattctggagcgcggccaatcatcaaaccggcgataaacacagccagtaggacaaatagcagcatgccatataagccggagcctacgccgccaaagatgacttcaccaatttgcatcaaccagagtggtatcatgccacccagtgccgtgaaggaatcgtgcattgcatttacagccccacaggaagccgcagttgtgacgacgctataaagagaggaggtaaggataccaaagcgggactctttcccttccatgttcagattactgctggcaccagcctggatgaagtggggattacccatgatttcggcatagatcacaatcgtaacggcgatgataaagacaatcgtcatcgcccacagcaaagcatgcccctgtcgattatccccgaccacaagaccgaacgcgaaacacagtgcacaggggatcaggaaaatggtaaggatttgcacaaagttactgagggcattcgggttttcaaaggggtgggctgagtttgccccaaagaaccctccgccatttgtacccagtaattttatggcttcctgagaagcaaccggccccatgggaataagttgttgttgtccttcaagggtgtgggcaagcgcatagggggagaaattttggataacgccctgactggcgaagataagtgcaatgattatcgacagcggaagcaatagatacagtgtaatgcgtgtaatatctatccaggcattgcctagtgtcttaacgccctgacgggaaaatgcccgcattaaggcgaaagctactgcaatccccgtggcggctgacaggaaattctgaacagtcaaacccgccatttgactcaagtaactgagggtattttcaccgctgtaggcctgccagttggtgttggtaataaaactgattgcggtgttgagtgccagatcccatttcataccggcaaaatgctgtggattgagcggcagatgttcttggcttatcaacagaataaagagtagcagcaaccccatgatgttgaatgtgatgatagcgagtgcatattgccaccagttcatctccttgacgtggccgccgggcttttgcaagccacagcaacgccacaggctgttttctgcacttgttagccagcggggtaattctccttcgaccagatttgcgatcagactgcctaggggtttgctcaatacaaagagaatgaccaagaaactggtaatcagcaaaaaagcggatactaccatttaaaaatcctccgcattcaataacgcgtaaatcagatagaacagtaatgacactgccagaaatacgccgataattatgaatgtattcattgtgcttatatccttattcactaggtggttacagcataagaagagccatgcaaagaagttgttaaaagagattatgaaagcgtaaaaaaagtataaaaatataagagggattaattgataaggtacccaaggaaagtctagcaaactttataagttgattttttgttttcaatgtgttggttttgtttctgtttaggtattaatttgtaattaaattacatcaatagaaaaaaagagtgatatataggctaaaaaaggggttgaataagtagcaagttttcattttgtcgggtaaaattttgtacgtattacagatatagcccatgaggagggtcttaatgtctacatatcgtgaatattcttggcatcaggttctcttgcggcgtactggcgctgtaacattgggcgtcattgcgcttcctgttatgctatttcgtcgggatcgtgcccgtttttacagttatctgcgtaaggtatggataaaaaccagcgataaacccgtatggctggagagctcggaaatggccgcaggtattcgaaatcgctaagacggcatcattatgtaagtaacatgactgtattgctctggtttgtcactttccattcttattttttcccctgatagagtattttgacaccttgcctgtttatgctgacgaggtgttttgcttttatcgctatttgttgctattgatgcgattcttgatgtggtgcatataagcaacaatcttgggagcaattaatgacaggtaagtattttatggcgaaagcgctcaatgacgggggaagtgtgatgaacaatgttgaattggaacatgtgctcaatacggaactgaatgtccgtgaatttcaggattatgcccccaatggtttacaggtggaaggccgtccccatattcagcgggttattacaggtgtgacagcatgtcaggctctgttggatgaggcggttcatctcgaagctgatgcggtcatcgttcatcatggatatttttggaaaaacgaatcacccgttatccgtggcatgaaacgccgccgtctacaaacactgctcagcaatgatatcaatctgtatggttatcatcttcctttggatgctcatcctacattgggtaacaatgttcagttggcgcgtcagatgggggtaaaaatcatcgggcagattgattccctgcttcctcatggagcatttgaccaaccgattacccccgcagagttgactgagcggcttgaaaaaagattagaacgcaaagtactgcattgtggcgataatgcaccggaagaaattcgtacactggcatggtgtacgggaggtggccagagttttattgagcaggcggctgagtttggtgtcgatgcctttgtgacgggggaagtatcagagaagactatccatgttgcccgtgagatggggctgcatttttatgcggcagggcatcacgcgacagagcgttatggtatcaaagtactcggtgaatggctggcgaaccattatgggttggatgtcacttttgttgatattcctaatccggcttgatttgttcgcaacttatcaatttgtcaggcggggctatcagaacggtagccccgttgttttttcccaatttgttttcgcagaacctgtttatcaccattttcttgttaaaagcacggttgatacgccacagcagatcagtatgctgcccaatgcctgactccagccagccagcgccaaaccgccgcccagcaagagataataaaatagccccagtaaggcgcctgctgtacccagccgatctacatagttgttcagtgccgatgctaaaatattgggaatggcaaggccgtaggcggtaacaatgcccagcatgggaaagataaatagccagctattttcgagcaggtaaacgccgatcccacttaataaaacaatcatcgcggcaagagagattaatttttccgatagccactgtttttttaacagatgcttgttcaatagtgaacctagcccaacgccgaaagtgaatagcaggccggtataaccgaactgtgcctgtgatagtccgaattgctgaaagcgaaagggagctaactggtaatagctgaacaggcaaatattgaaaaatgcgatgagaaacgcatttcgccaaatcgaaatatctttgaacatggtgacggcggtgccaaatagggcaatttttggcacatttactggccgggtttccggtaagcgaataacagaccagcccattaggatagcagacagaatggccagtccggcaaataccgctttataacccccaaaatgatttagtatagagccgctgatcatgccaatcgcagggctggcagctaaagcaatccccatgatggaaaaaatccgtgatagttcttcgccgcagtaagtatcacgcatgatagtttgcgtacagacagaaccgacagctgccccaaaggcggataacattctggcagccagtaatagccagaagtgttcggttaacagtgccagtaaggaagctgcgccatagagcaataatcctgcaatgatggtaggacgcctgccaatgacatcacacatacgcccccatacgacaacaccgatggcaaaagcaaagaaatagagtgacagggtttgggcagcctgttctgcattgacagaaaatccactggcaatattggttagggcaggactatagatggtttccacgatctgtggaaacatcatcaaggtgatagcgagccaaagcgatggtctagtgtgcatgatattttcttctgatgaattatttatagcccgaaaggttagcattctgctgaatgtctttttatgataataaaggcagtttatttatgtattcggacataaagttaaaggatattaatatggcgtggctgcgacaaagtgatcattttgatcctgatggtttgaaatatagtttgaatgtgcccgtgataggcattgcggcagagatggggcagcacgattcaggctttcatcagcatgatatggggcaactgttgtttactcagcagggttgcatcaagatcacgctggcaaatcaactctctatcctgcctccgacccgagttgcatggataccgccaaagacattgcatcgggcggaaatgcgtggctccgtaggatatcgctccatttatctggatatttccgggatagagtggatttcgaggcagagtgaaatcttgcaaaccacaccattgctacgggtgattttagaacgtattgcaatatctccttttgataccgattggcgtcagggaaagggagcgcatttattggcggtcttttttgatgaaatgagtgatgcaggtaaagaaccgactttattaccactaccttctgatcggcgtctggcacgtttgccgtttgaacaatttcctccgccattacaaatacttgccactcatgttggcgccagtgagaaaactatcacccgaatatttctgcgtgaaacgggaatgaattatcaacagtggcggcagcaatggcggctgataaaagccattgagttacttgctcaggataaaactctgtcttatgtcgcacaggagctgggatttgctaatgatagtgcgtttgtgacattttttcgcaaaaatatgggaagaccaccgagggagtatatggccggtgcttgcaggcgataactgcaccttaatcaggttcaatattacgattgaacctgattaaggtgcagttcatgcacttgtcagataatgtctgactatgaaataaagaatactaaattatttctctaactgacttttgaaatcacgttgggtatggccagtataaagctggcgtggacgagcgattctcaagccttcatcgtgcatttcagtccagtgcgcaatccagccaatagtacgggcaatggcgaaaatcacggtaaacatggaggatgggatacccattgctttcaggataataccggagtagaaatcgacattcgggtacagtttcttctcaatgaagtacggatcattcagggcgatacgctccaactccatcgcgacttccagcaggctgtcattcaggcccagttcattcagcacttcatggcaggtttcacgcattactgttgcgcgtggatcatagtttttataaacgcgatgaccaaagcccatcaagcggaaagaatcgtttttatctttggcacgagcgataaattcaggaatatgttcgacagtctggatctcttccagcatacgcagacaggcttcgttcgcgccaccgtgcgcaggcccccacagggatgcgatgcccgctgcaatacaggcgaatgggttagcaccagaagaacctgcggtacgtaccgttgaagttgaagcattttgttcgtgatccgcatgcagaatgaaaatgcgatccatggcgcgttctagcactggattgactttatattcttcacaaggtgttgagaacatcatgtgcaggaaattggctgcataagaaagatcgttacgtgggtaaacgaaaggctgcccgatagaatatttgtaacacattgccgctacagttggcattttggacagcaaacggtaagcagtaatttcacggtggtgagggttatggacatccagtgcatcatggtagaaggcagccagtgcacctgtcacaccacaaagtacggccattgggtgagaatcacggcggaaaccgtggaacagacgggtgatctgttcgtggatcatcgtatgacgaatcaccgtttttttgaatgtttcatactcttcaggcgtgggtggttcgccatacagcaggatataacagacttccagatagcttgatcccgttgcgagctgatcgatcgggaaaccgcggtgcagcaaaatgccttcgtcaccatcaatataggtgatttttgattcacaggaggccgtagaagtaaagccaggatcgtaggtatagaagctctttgagccgagggtacgaacgtcaatcacttcagaacctagggtcggcgttagtacgtctagttcgatagcagctgcaccatttatggtcaacgtagcttttttatcagccatttacatctccttagcgcttatttttataacccctaacaaccatgataggcgcaatttatactgtgccgatggcattgtgctaccggagagaatttaaaatcaggctggtatcacattatataacgctgaaatctcattacgggcgacaacgatttttaggttgttaaaaagtttctgggtgttatgtttaaagtattcttaacataaaatgttgtcattttgtgtctaatgagtacttttgcataacttttgtttttcgtgaagtttacttttccgccggaaaacgacggtaaacaatatataccgtcatatatgtaagataaatgtttaatccttgtcaaataagataatggtttttatgataaatgtttgaagcgtgatctttctcactgttcaagctaaatgttaacaatcatattgtgtgggaattgtaataagtatgtgaagtacctatactgccgtaaggtctccggattaccctgctgcaggagcatccagcgtagccaaatcacaacttttgatgaacatgtaaggattgttaatttaattatgttgtgtctttgtatcctcttagcgctgtctgattcccgcccaggaccggaggatggaaaataaaaaaagctgtgtgggcaaaattgtgaaaaaacaaagacctgtcaacctcgatttgcggacgattaaccaacccgtctccgcgataacttcgatcttgcaccgtatctcaggcgtcattacctttatcgcagtcggcattttgctgtggttgctggggatgtcactgtcttcgcaagagggcttcctgcaagcatctgaaatcatgactggcttcttcgctaaatttatcctgtgggggatattgacggcgttggcttaccatatttgtggtggcatccgccatgtattgatggattttggtttcttggaagaaaacctcgctaccggtagtgcttctgccaaagtagcaatagtgatcgcggttattctgtctattctggctggggtattattatggtaagcaacgcatccgcattgggtcgcacgggtattcaggactggctgctgctgcgtgcatctgcaatcgttattgttttatacgtcctttaccttgttggttttgtagcaacaacgtcagacatcacctatgaagtctggcgcggtttcttctcttcatctctcactaaagtgttcaccgtgctggtactgctttccattctggttcacgcatggatcgggatgtggcaggtgctgacggattatgtcaagccactcgcactgcgtttggtgctgcaactggtcattattgttgcgctgttggtttatttgatttacggaacaattgttgtgtggggtgcataaatgaaactgccagtaagagagtttgacgctgttgttattggtgcaggtggcgcaggtatgcgtgctgcactgcaaatttcacaaatgggtttatcctgtgccttgatctccaaggtattcccaacccgttcacataccgtttcagcacagggcggaattacggtcgctctgggcaatacccatgaggataactgggaatggcatatgtatgacacggtgaaaggctccgattatatcggtgaccaggatgccattgagtacatgtgtaaaactggccctgaagctattctggaattggagcacatggggctgccattctcccgtctggataatggccgtatttatcaacgtccatttggtgggcaatccaggaattttggtggcgagcaggctgcccgcactgccgctgctgctgaccgtacgggtcacgctttgttacatactctgtatcagcaaaacctgaaaaataacacgacgattttctctgaatggtattcactggatctcgtcaaaaatcaggatggtgctatcgttggttgtactgccatctgtattgaaacgggcgaaatcgtctatttcaaatccaaggcaaccattctggcaactggtggcgctggtcgcatttaccaatccacaaccaatgctcatatcaataccggtgatggtgttggtatggcgctgcgtgccggcgttcctgtacaagacatggaaatgtggcaattccacccaacgggcattgcgggtgccggcgttctggtaacagaaggctgccgtggtgaaggtggttatctgctgaataaaaatggtgaacgcttcatggagcgttacgcgcccaatgctaaagatctggcaggtcgtgatgtggttgcacgttccatcatgatcgaaatccgtgaaggccgtggctgtgaaggtccttggggacctcatgcaaaattgaaactggatcatctgggtaaagatgtattggaatcccgtctgccgggcatccttgaattgtcccgtacttttgctcacgttgatcctgtgaaagagccgattccggttattccaacctgtcactatatgatgggaggaattccaaccaagatcacgggtcaggcgctgactgtcaacgaaaaaggcgaagatgtcatcattccaggcttgttcgctgtgggtgaaattgcttgtgtatctgtccacggagcaaaccgtctggggggtaactcattgcttgatctggtggtattcggccgttctgctggcttgcacctgaaagagtgcctgatggagcagggaaccagccgtgacgccagtgagtctgatgttgacgcagcactgcaacgcctgaaccgctgggataatacccgctccggtgaagatccggttgaaatccgtaaggcactgcaagcctgcatgcagaacaacttctcggtattccgtgaaggtgatgcgatggcaaaagggctggaagagctgaaagtgattcgtgaacgtctgcaaaatgcccgtctggatgatacttcatcagaatttaatacccagcgcatcgaatgtctggaactggataacctgatggaaaccgcatattcgaccgcagtgtctgcgaattatcgtacagaaagccgtggtgctcacagtcgttttgactacccagagcgtgacgatgcgaactggctgtgccatagcttgtatttaccgcaaactgagagcatgactcgccgtgaagttaacatgcagcctacgctgcgtgaagctttcccgccgaaagtgcgttcttactaattgcgttgctgatgttccagttgcggagaaagagattatgaaacttgaattttcgatttatcgttataatccggatatagacaacgcaccccgtatgcaggattacacgctggaagtagaagaagggcgtgacatgatgctgctggatgcgcttatccagttaaaagagcaggacccgaccttatcattccgccgctcttgccgtgaaggtgtttgcggctctgacggtgtgaacatgaatggtaaaaatgggctggcttgtgttactcccgtttcggtactgcgccggggtaataagaaaattgttattcggccattgcctggtttacctgttgttcgtgatctggttgttgatatgagccagttctacacgcaatatgaaaaaatccgtccttatttgattaacgatggtaaaaacccacctgcgcgcgaacatctacaatcaccggaacagcgtgaaaaactggatggcctctatgaatgtatcctgtgtgcctgctgttcgacgtcttgtccgtcgttctggtggaacccagataagtttattgggccggcaggtcttttggctgcgtaccgtttcctgattgacagtcgtgatactgaaacggcttcacggttggatggcctgaatgatgcgttcagcgttttccgctgccatagcatcatgaactgtgtcagcgtctgtcctaaagggctgaacccgacaaaagcgattggtcatattaagtcgatgctgctgaaacacagcgcataagtaaaatatagtgcataaataacgcataaatcgcgtgtaaataatgcatataatgttgccctccacaattttgaaagaaatatcaagctgatggagggcattaagaatgaaaaatgataaattgcctactgcgaatgacggcgcatgttttgaaataaaggaacctttaaaaaccgatatccagtttttaaaggttccttgaagggtaggaaaaccccaataaagaacatgcattaagcacgtccaaatgaaccttttatcaacaccgctcattaagcggtatttgttaaccacggcgaaaactaaagcttttaaagcttaagggatcacaatgcagaacggcgcaatgaaggactggctggactcgagctttctggctggtgcaaaccagtcttacatagagcaaatctatgaagactatataaccgatcctaactccgttgatgcaagttggagagaaatattccaacaattaccggatacaggacttagcggggaacaacttcactcacagacgcgcgattacttccgtcgtctggcaaaagatgccacgcgttatcacacttcagtcagcgatccagcaatggatgcaaaacaagttaaagttttgcagctcattaacgcattccgcttccgcggccatcaaagtgcgaatcttgacccattgggattatggaaacaggaacctgtacccgatctcgatcctgttttccataatttaacaaaagcggattttgaagaaacgttcaatgttggctcgtttgccattggcaaagagacaatgaaactggctgatctatatgacgccctgaaacgcatttactgtggttcaattggtgcagaatatatgcatatcaccaatacggaagaaaaacgctggattcagcagcgtctagaatccgtggcggtaggttcacagttcagtgcggatgaaaaacatcgtttcttggcggaactgacagcagcggaaggcttagaacgctatttgggtgctaaattcccgggggcgaaacgtttctcccttgaggggggtgatgcgcttatcccaatgctgaaagaactgatccgccatgcgggaaaacagggtacccgtgaagttgtgctgggaatggcccaccgtggtcgtctcaacgttctggttaatctctttggtaaaaagccggctgatctgtttgacgagtttgcgggtaaacacaaagagcatctcggtacaggtgacgtaaaataccatcagggcttttcctctgatttcgaaactgaagggggattggtacatttggcgttagccttcaacccatctcaccttgaaattgtcagccctgtcgttattggttcagtacgtgctcgccgtgaccgtcttgatgaaggtcaaagcaacatggttctgccagtaaccattcatggtgacgctgctgtaatagggcaggggattgttcaggaaacactgaacatgtctcaggctcgcggctatgaagttggcggtactgtccgcatagtggttaacaaccagattggtttcactacctctaatccgaaagatgcccgttcaacgcaatactgtactgatattgtgaaaatggtacaggcgccgattttccacgttaatgcggatgatccggaagccgttgccttcgttactcgtttggcgcttgatttccgtaataccttcaaaagtgacgtgatgattgatctggtttgctaccgtcgccacggtcataacgaagctgatgagccaagtgcaactcagccactgatgtatcagaaaatcaaaaaacagccaacaccacgtaaaatctatgcagataaactcatagcagaaggcctgctggcagctaacgatgttactgagatggccaatctgtatcgtgatgcgctggaccatggtgagtgcgttgtggatgaatggcgtcctatgggaatgcattcatttacgtgggagccttacctgaaccacgaatgggatgaggattatccacataaagtggagatgaaacgtctgcaagatctcggcaaacgtatcagcactattcctgctgaagttgaaatgcactcacgtgttgcgaaaatttacggcgaccgtgcagaaatggccaacggcaataagctgtttgactggggtggtgcggaaacactggcttacgctactctggttgatgaaggcatccctgtgcgcctatcgggtgaagatgcgggccgtggtacattcttccaccgtcatgccgttatccataatcagccgaatgctgctgtttatgtccctctggcaaatgttcacaatagccagggtgtattcaacgtatgggattctgttctgtcagaagaagcagtactggcgtttgaatacggttatgcaacgacagaacctcgcgctttgacgatttgggaagctcagttcggtgatttcgccaacgtggcacaggttgtgattgaccagtttatcagctccggtgaacagaaatggggccgtatgtgtggcctggtcatgctgttgccgcacggttatgaaggtcaaggtccagagcactcatcagcacgtctggagcgctatctgcaattgtgtgcagagcagaatatgcaggtttgtgtaccatcaactccggctcaggtttatcacatgctgcgccgtcaggctctgcgtggtatgcgtcgtccgctgattgtcatgacacctaaatcactgctgcgtcatccattggctgtctccagtctggatgaactagctaacggtaaattcgagcctgtgattggtgaaatcgacgccttggatccaaaaggtgttaaacgcgttgtactttgctccggtaaagtttattacgatctgttggagcagcgtcgtaagaacgagcaggctgatgttgccattgtgcgtgttgaacagctgtatccattcccacgtcagaacttgcagactctgcttgagcattatgctcatgttcatgacttcgtctggtgtcaggaagaacctctgaaccaaggggcttggtattgcagtcaacataatttccgtgaagtgatcccatttggggcttctttacgttatgcaggtcgtccagcatctgcttccccggcagtgggttatacgtctgttcaccagcagcagcagcaagcgctggttaatgatgccctgaacgttgaataaataaggatagaaaatgagtagcgtagaaattctggttccagaccttcctgaatctgttgcagatgccactgttgcgacatggcataaaaaagcaggtgacactgtacaacgtgatgacgtgttggttgaaattgaaactgataaagtcgttctggaagtacccgcgagtgaagccggtgttctggaagctattttggaagaagagggtgccacggtactgtccaagcaactgctcggtcgtatccgtttgagtgatagcacgggtattcctgctgaagtaaaagaaaaaacagaatcaacaccagcacagcgccagactgcttctttggaagaagaaagcaacgacgtattaagtcctgcggttcgtcgtctgattgcagagcatgatttagatcctgctgcaattaaaggcagtggcgttggtggccgtatcgttcgcgaagatgtggaaaaatatatcactgcgcataaaaaagagagtggcaaagtggctgaagctgcaccagcacagtcttctcagctgccacatcgtagtgagaaacgcgttccaatgactcgcctgcgtaaacgtgttgcagaacgcctgcttgaagcgaaaaacaacactgcaatgctgacgacgttcaacgaagtcaacatgaagccaattcaggaattgcgcaagcagtacggtgacgcgtttgaaaaacgtcatggcatgcgtctgggcttcatgtccttttatgtgaaggcagtcgttgaagcactgaaacgctatccagaagttaacgcttctattgatggcactgacgtggtttaccacaactattttgatatcagcattgcggtatctacacctcgtggtctggttacaccagtactgcgtgatgcagatgcactgggcatggctgatattgagaagagcatcaaagagctggctattaaaggccgtgacggtaagttgaccgttgaagaactcactggcggtaatttcacaattaccaacggcggtgttttcggttctctgatgtctacaccgatcattaacccaccacaaagtgcgatcctcggcatgcatgccatcaaagatcgcccaatggcagtgaatggtcaggttgagattcttccgatgatgtatttggccctgtcttatgaccaccgtctggttgatggacgtgagtctgtaggcttcctggtaaccatcaaggaaatgctggaagatccgacacgtttgttgctggatgtatagcatcaccatcggggtggagggtgttaaattctgcccagtctgaagtaaagcaatgttgatgtaaaaaatgtatatgcaggccagcccccgggctggtcatatccagagcaacaaaatagaaggtaatttacctttcttagactaaattatggatagaacatcatgaatttacacgagtatcaggcaaaacaactttttgcacggtatggtttaccagctcctgctggttatgcctgcaccacaccgcgcgaagcagaagaagcagcatccaagattggttcaggtccttgggtcgttaaatgtcaagttcatgcaggtggtcgcggtaaggctggtggcgtgaaagtcgtcaacagcaaggaagatatccgtgcttttgctgaacaatggctgggtaaacgactggtaacttaccagactgatgcgcagggtcagcctgtacatcagatcttggtggaaggggcaaccgatattgccaaggaactctatcttggtgctgttgttgaccgtggtacacgtcgtgtagtgtttatggcctctaccgaaggtggtgtcgaaatagaaaaagtggcggaagaaacgcccgaactgattcataaagcaatcatcgacccactggctggccctatgccgtatcaaggccgtgaactagcgttcaaactgggtttaaccagtaaacaagttggtcagttcactaagattttcatgggattggcaaatctgttccttgagcgtgatctggctatggtcgaaattaaccctctggttattacaacccaaggtgatcttatctgtctggatgggaaactgggtgcagatggtaacgcaatgttccgtcaggctgaattgcgtgaaatgcatgatccttcacaggaagatccgcgtgaagcccaggcagcacaatgggaactgaactatgttgcgcttgatggcaacattggctgcatggtgaatggtgctggtttggcaatgggaaccatggacattgtcaaactgcacggtggcgccccggcaaacttccttgatgtgggtggtggtgcgacaaaagaacgtgttaccgaagcattcaaaattatcctgtcagatgaaaatgttaaagctgtttttgtgaatatttttggtggcattgtccgctgtgacttgattgctgacgggattattggtgctgtggaagaagttggtgttcacgtaccggtagtggttcgtctggaaggaaacaatgctgaattgggcgcgaagaaactggcagacagtggtttgaacatcattgcagcaagcagtttgacagacgcggctaaacaggcagtcgcagcagcggggaataaataatgtctattttaatcgataaaaacaccaaagtgatctgtcagggatttactggcagtcagggtactttccattcagaacaggcgattgcctacggtactcaaatggttggcggtgtgacaccaggcaaaggtggcactgagcatctggggcttcctgtattcaataccgtacgtgaagcagtggaagcgactggtgcgacagcttctgttatttatgttcctgctccattctgtaaagactccattctggaagcgattgatgcaggcatcaaactgatcattaccatcacagaaggtatcccaactctggatatgctgacagtgaaagtaaaactggatcaagcaggtgttcgcatgatcggtcctaactgtccgggcgttattacgccggatgcgtgtaagatcggtatcatgcccggccatatccacaaggcaggtaaagtgggtattgtatcccgctctggtacattgacttatgaagccgttaaacagacaacggatgcagggttaggccaatctacctgtgttggtatcggcggtgacccaattccaggctcaaactttattgatattctgaaactgttccaagaagatccgcagactgaagctatcgtcatgatcggtgaaattggtggtacagcagaagaagaagcagctgcttacattaaagagtatgtcactaagcctgttgtcgcttacattgcaggtgtaactgcgcctaaaggtaaacgtatgggccatgctggtgcgattattgcgggtggtaaagggactgcagatgaaaaatttgctgcattggaagcggctggagtgaagacggttcgcagtctggctgacatcggtgacgcagtaaaaggtttattagcaggcaactagtcgaaaaataagctatttttattgaaaaaggtcaccttagggtgacctttttatttatatttataatatatacagtaagttagttattttatacaaataggtatttttaaatttaacttaactgggtctcgaatatgttatttatttgattaatttaattggaaatattgaaaaaatatatttttcaaagaatgaaaataaaaagttaattttcgaatgttttttacagcaaaaaataaatcaaaagacattgaaggcaacaaattattaacactaaatcaaccagaatgaaataatagctgtaatgattaacaaaaaaaggaaaaaattgactaaaatcaatttattactatggtatgtattcgctgagtttgcttaaattgatctaaaataattagatattagcctaagaatgtacggcattattgacctatattcagaattccaagctgagtcacgtaaaacctatttattgtgtgtgaatataggcgtaatattattgtgatatctactgaatatctgatttacttaataattcattgttgtgttttaggcatttattgctggtagttacgagacttccgtttacggagtcgggttgccgcaagtcggtgtcttcctgctaggagcaaggagtcaagatgtttgatattgtcgaactgtcacgattacagtttgccttaactgctatgtaccatttcttgttcgtgccattgacgctcggtatggcgtttttgcttgcgatcatggaaacggtatatgtcctttctggcaaacagatctacaaagatatgacaaaattctggggtaagttatttggtattaactttgctctgggtgttgcaacgggtttgaccatggagttccagttcggaaccaactggtcatacttctcacattacgttggtgatattttcggtgcaccgctggctattgaaggcctgatggcattcttcctcgaatccacattcgttggtctgtttttcttcggatgggatcgtctgagcaagaaacaacatctggctgttacttggctggttgggctgggctctaacttctccgcattgtggattctggttgcgaacggttggatgcaaaacccgattgcgtctgatttcaattttgaaaccatgcgtatggaaatggtgagtttcagcgaattggtgcttaaccctgtggctcaggtgaaatttgtacacactgttgctgcgggttatgtgacaggcgcggttttcgtcttgggcatcagctcttactatctgcttaaaggacgcgatattccgttcgctaaacgatcttttgcgattgcatcaagttttggtattgctgcgatactgtctgtcattgttctgggtgatgaatctggatacgaaatgggggacgtacagaaaaccaaactggctgccattgaagctgaatgggaaactcaaccacctccagcttcattcactctgattggtattccggatcaggataaaatggaaaataaatactctattcaaattccttatattctgggtctgattgccactcgttccactgatacacccgttgtcggcctgcgtgacttgatgggccagcatgagcagcgtatccgtaacggcattaaggcgtacgaattactggaagagttgcgttctggcaatattgatccaacggttcgcaatgcatttaatgaaagtaagaaagatcttggttatggcatgctcgtgaagcgttatacccaagacgtagcaaatgcgacagaagaacagattaaatccgctgcgaaagattctatcccacgtgtagcgccactctactttgcattccgtattatggtcgcttctggttttctcatgttgctggttatcggtctggcattcctgagtgttattcgtaatcgcatcggtcagcagaaatggttgctgcgtgcagcgctgttcagcatcccactaccgtggattgctattgaagcagggtggtttgttgcggaatatggtcgtcagccgtgggcgattggtgaaattctgccaaccgcagttgctgcttcgacacgcagtgttggtgatctgattttctcaatggtactgatttgtggtctgtacactttgttcttgatcgcagaaatgttcttgatgttcaaatttgctcgtctgggtccaagtagcctcaaaaccggacgttaccattttgaacagaaaaccgcttcttcagccaacaatattgagtaagcaggagtccacttatgcttgattatgatgtattacgatttatatggtggctgctgattggtgtgttgctgatcggtttcgcagtgactgatggtttcgatatgggagttggtgttctgctgcggatcatcggtaaaaacgatactgaacgccgcatcatgattaactcgattgcccctcactgggatggtaatcaggtttggttaattacagccggtggcgcactgtttgctgcatggccgatggtatatgctgctgctttctctggtttttatgtcgcgatgatcttggtattggctgcgctgtttttccgtcctgtcggttttgattaccgttcaaaactggaaaatagtcaatggcgcagtatgtgggactggggaatcgttattggtagctttgtaccgccgctagttattggtgttgcatttggtaatctgctgcagggtgtaccgctggcgatagattcctatatgcgattgtcctatgaagggtcattcttcgggttgttgaatccttatggcttgttggcgggtatcatcagcctgatgatgatcgtgacacaaggtgctacttacctgcaaatgcgtacaaccggtgagttgcatctgcgttcgcgcactgccacacatgtctgtgcattggtaacagtagtcgccttcctggtggcaggcgtatggttgatttatggcatcgatggttatgttgtgacaggagggttggatgttaatggcccatctaacccactgcataaagaagtcgcgcatcaggcgggggcatggctgattaactttaataaatatccggcgctgtgggcagtaccggcattgggtgtcattcttcctctgctgactatgctggcgacacgaatggataaaggggggtgggcattcctgttttcatcattgaccgttgcctgcatcattctgacttcgggaattgcgatgttcccatttgtgatgccatcaagcattgatccgaatatcagcctgactatgtgggatgcgacatccagtcagtggacattgcaagttatgtttgttgttgcacttatcttcgttcctcttatcttgtcgtacaccacctggtgttactataaaacttttggacgtttggataagaattatattgaaaacaacaaaaattcactgtactaaggagcatagcgcatgtggtattttgcttggattctcggaacgctcttagcttgtagtttcgctatcattgcagccttggcacttgagcagagcgaatcaaaaaaagcaactgagagtggcgaaaaataatgttggctgataaatgctaccaactcatggataaggggcctctgagggcccttatcctcatcatggctctggcgcttgcctcatgtgtattctgggatcctgcacgttttgctgctaacaccagttcacttcatgtgtggcagggtgttttactgatttgggctgtttgttctggtgttacctttggtgtcggatttcatcctaaacagattatctggcggcttttttttcatccattacctgcatttttcattcttctctttggcttatatcatttttttaagtaaactatttataaatttatagaccgatggtctataaattttttttgatttctttactgacaagtcattccaaagcgcgattgtcttgagtatagtggcagcgtcaattcgcctgattaggattatatgtgagtaatatgttgttccgttggcctatccgtgtttattacgaagacacagatgctagtggtgtggtctatcacgcgcaatatttagccttttatgaaagagctcgtactgaaatgttgcgtgaaaaaggcttccatcaaaagtatatgctggatgagcagattggctttgttgttagtcgcatgactgttgactaccggaaaccagctagattggacgacttgctggttgttgaaagcgaaattacgaatattcgtggcgcttctctgacatttactcaacgaattgttgattgcaatggtgtagctatcagcagcgcagaatctctggttgtctgcgtgaattcatctcaaatgaagcctattgcgcttccaaagtctattgtcgcggagtttaagcagtgactgacatgaatatccttgatttatttctgaaggcgggctttttagtgcagttgatcatgttaatcttgatcggcttctctattgtttcttgggcaatcattattcaacgaacgagaattcttaatgctgccacccgagaagcggaagcatttgaggataagttttggtcgggaatcgaattgtcccgtctttataaagaaagtcagtcacgccgtgattcgttaaacggtactgaacagattttccattctggttttaaagaatttgctcgtttgcatcaagtgaatagccatgtaccagaagctgttatcaccggggcttcccgtgccatgcgtatttcaatgaaccgtgaactggaaacagtggaaaatcacattccatttttggggactgtgggttccatcagcccttatattggcctgtttgggacggtttgggggatcatgcacgcctttatcgccttgggtgcagtgaagcaggcaactttgcaaatggttgctcccggtattgctgaagccttgattgcaacagcaattggtctgtttgccgccattcctgcggtgatggcctacaaccgtctgagccagcgcgtcaataaactagaacaaatctacgataattttatggaagaatttctggcgattttgcatcgtcaggcttttactcctaataccaataagtcgtaataaatcgttaggggaaataagcgaatggcgcgcactcgtagtcgcagacgtgagctaaaatccgagatcaatatcgtccccttgctggacgtgttgctggtgttgctgcttatctttatggcaacggccccgattatcacgcaaagcgtagaagttgacttacctgatgcggtggattctaaggcagtttccagctctgataatccgccggtcattatggaagtttctggtattgggcaatacaatatgatcgttaatcaggaacgtctggaattgttacctgaacagcaaatcattgttgaagctcaagccttgatgaaagccaatcctaaaacagttttcctgattggtggttctaaggaagttccttatgacgaaatcatcaaggcgctgaatatgcttcgtcaggcgggtgtaaaatcggttggtttaatgactcagcccattggggcctgatggttgctgttacttaaagtttctggatgtcgagcgtgggaaagacaaacgagcaaaataataggctgaatcgcgccattatcatttcggttatacttcacattatcctgatcgggtttctgatttggggttcgctgatgcaaaaaacagaaatgggaggcggcggagctggtggtactgtcattgatgctgttatggtcgatccgaatgcagtcgttcagcaatacaatcagcaacagcaacagcaggctaatgcaaaatcggctgagcagcagcggaagaaaaaagctgaacagcaggcggcggaattacgggtaaaacaggctgaggagcaggaacgcttgaagtcggcagaagaagagcgaataaaagcacaacaggcgtctgaagaacagaaaaaacaggctgatgccgccgcttcgaaagcccgtgaggaacaaaaacttgcggaagaagctgctgctaaggcgaaagcagaaaaagaaataattctaaaggaacaggcagaggctcggcagaaggcagaggttcaggccaagaaagaagcggaagagactgcgaaacgcaaagccgcatctgaggcgaaggctaaagcagaagccgaagctcaggccaaagcagaggctgaagccaagaccaaagctaaagcggaagccgagtctaaggtaaaagccgaagccgaatctaaggcaaaatcagaagccgaggcagaaaccaaagcgaaaacagaagctaaggccaaagccaaggccaaggcagaagcgacaaaacaggctcaggaagttgatgacctgctgggtgggttaacgtccagtgcacctaagcagggcggggcgtctgcggctggtcaaggtggcggcaagaaaagcggcccttcacagtcggatatcaataattacaaggggcaaattcagactgcaatccagcagaatttccatgacccgagtttgtatctcggacgtacttgtgagttaaggataaaattggcaccggatggcctgctgattgatattaaggctggtgcgggtgaccctgcgttatgcagggcagcggttgcggcggctcgtcagactaaaattccacgaccaccgagtaaagagatttatgagcatttcaagaattcctcactggatttcaagccccagtaaggtaattatttggtagaaaagcgttatttgctagttaaaaatacgaataatttatatatacaaacaaaattattagattttatttaggtatctagttttgtttgttggcctttgttagaatccggcggattattgcgggcatataaacgatcgcgataagggagacatgatgaagcaaacttttaaacagtcgtttaaaatagtattaggctttttgatgatgtgggcagcgcttgctcatgcggaagttcgcattgaaattacacaaggtgttgattctgcacgtcctattggagtcgttccatttaaatggacaggtgcagccaatgctccagaagaaattggttcaattattgctgcggatttgagaaacagtgggaagttcaatcccattgattcaaaccgtatgccacaacaacccacaactgcatcagaggtaacacctgctgcatggtctgcc

SEQ ID NO: 16894 - DNA, 171354 bp, Xenorhabdus bovienii
tgttcatagaaatgtcaaatacaccataccaattagacaggagaggctatctgactagcgatggattgagccaactgactataacctgttgccaaagtgcgtactaattcagcataaccatctattttctgtttcaactcaagattgaatggccgtttaatcacaccattctgattaaataacatccaatatccttgaatcatcacctttccgtcataccgtccgtgaaaagcggttattgtgatattcagtgtatccgcatttttctccagcggttgtccggcaacgagtttttgtggaaatgccgcgcttagttccgtgatcaaaacctgctgtaattgttgttctaatgggctagcccacaagtgattcgaagcattgacatagatcacgtcccctgtttgataaacgatacccggtgatgcaaggtaatcagcaagagtcactccttttacccataattgtcgttcatctttgacacctaatcgactttcctgtgatgtactcgttaaagccggtagctggtagtaagttttttgcggctgactactgctgcaccctgaaataaacacgctactaacagcaaaaacactgacagaaataaaaaacgccaatcttaacatcaactttttcattagttacgcgcctttttgggttcaggatctttcatctcttcagcttcaaataccaatgcgttgcttttattgttaagtgtcttcaagacaggttgcaattcacgcaagacttgatccagccgttgcatattatcaatcagcttattgtaagccggagatccgggttgaatgccctgcatactgcggtttaattcttgcagtgtattttgtatatctttgggaagcccctgagcttctttgctcgcaaggatgcgatttaattcatccattgtttttcgagctgccttgatggttttctggctttcttctaatgtccgggtagcttgaacaaatacgggctcaatcggcatattattaattttatccagtgccataatgactttttgctggatttgagccaacccaccacttactgttggcaaaatttcataacctgcgatttcatatggacctgtccatttttcctcattggggtaaaagtccaaatcaatgaacaatgcccctgtcagtaagtttcctgatttcaaagaggctctcaggccgcgcgcaataatttcctcaagttccttatcagtataaaaaccactaccaatctctttctcaaaacgctcaggttcaatatgaatcaatacgggaatacggaagtcattatcaagtcgctgtctaacgccttcagtgtaaaaaggcacttttgccacagttcccacccgtatgccgcgaaattcgactggcgctcccagctgcaagccacgaactgaatcagcgaaaaacaacaataagtctttatgctttgtatagagtgagttttggatatttttctcactgtcataaagtttgaaagtttctttttctttaaccgggttgcccaaatcccaacctttcggtacatcaaaactgacaccgccgccaaacagagtggataatgatgcaacctcgacccgtagcccctgtgaggacatgtcgaaggcaacaccgctgtctttccagaatctgacacccgaggtcaacaatccatcatagggtgcattgacgaaaatttggtagcgcattaaccgcgatttgggatcaaaagtactggtttcaaccgaacctacccgatacccccgaaatagcacagggtcaccgggagttaactgccctgctttttcactgattaagaccagacgcataccttttgcatcaggagacgccagcggaggtgaatccagtaatgaaaatttattctcttcaccaccttgattgcctggctgtaattcaataaataccccggacagtaatgtactcaagccagaaataccttcacggccaatttgaggtttaacgacccaaaacgcagtatcttggtataatagccgctccataccatcattcaggcgagccttgatgataacttggcctaagttatcactcagtgacacacgttcaactataccgatatcaacactacggctttttattttggttttgcctgcttcaatgccctcagcattggatgtcatcaatgtcacttcaggcccttgatgactgaaatgataaaacaatatccaggcgccaattagcacagtgataattggcacaatccatacaggtgaccaactcttgagtttactgattctggcctgagtcagatcttcttctttatccgtcaccttacgactcctcatttttctgtaactcaaatttatgattggctttgtcccaagttaagcgcggatcaaatgttattgacgcaaacatcgtcaagataacaaccagagcaaacaggactgctccggtggcaggatagacactcatgaactgccccatgcgaaccagcgctgatagcaccgcaataacgaaaacatcaatcatggaccagcgcccgacaaattcgaccatttcatagataaaatgcatcgtttcagaatcatgactgctctgactcttcgcatcccagcacagccaactgatagccagcattttcagtataggcaccataatactggcgatgaaaataaccattgcaaccgggtaagaacctgtgctccaaagtagaataatgccttccagaatggtggagttaatatggctactcaatgcctgagtcaccataatcggcagcaggttcgctggaatataaagtatggcggatgttatcaatagtgccatagtgtattggaggctatggcgacgacgggcatgtcccgtagtatggcagcgggaacactgcggcagctgggctggcaagatggcggtacaacactggcaccgcctgacaccttgcaccaaacccggtttacctgcctgtaaaggtatacacacttcaggtgctggctctatttcattccaaaaccagtgtctgtcaagacattgaaatgctctgacctgaaacaggcagaatagacaataaggcaggaaactcaacccaataccaatgtcgccataagccattaacttgacaaagctaactaacactcctgcaaggaagatctctgccatgcaccaggttttcatctgaaataaaatacgcgccagctcaattttcaagcgacgcgccatcttaatgttctgacacaaaagaataatggcgaccatgcaaaatgcaggtacgagctgaacaaaaatcaggaaaaacactgctatgcttgaatagtcttcgctaaacatcactttcgggatctgaggcagcgatatttcactgacaatacccgcgatattcatgctaacaaacggaaagaggctggcgaggaacagcatcaataatgcactcgctgcatagcctgttggctgattacgtggctctttccactttgctgtcagcaaagtctcacatcgggggcaagccgctttattcccttgttccaagttaggcacggccaccagcatgtcacactggggacacaaaaccagcttgtcatgctgatgattattggaacacaaagtgtttctcctgtagcaaatcaacaaggccatactcttgatctttcaaattgctgctgcgttcactcaccccagccacatagtgatctatgcgcccgggggatttcttcacttaccgccgcgctgcaaattgaaatttattggaaataggcagcagccatcatccattttttatcatttccagttcctgccagcgatcaaaagctttttccagcttttgctctttatttgccaattcattcagaacattttgtgtgactgcgtgtggttgattgaagaattcagaatcaccgacctgggattgcaattgttctatttcttcctctaaggtttctaataatgatggtagttgttctaactctcgcagtaaatggtaacttatcttattgcttgcccgtttagatgtttctttagacttgactgccttcgtttcgatactgttttttttctctgaagactggtgtagggagatagtctgcgtccgttgttgttgggcatcgtaataacctcctacatagttattgatttcgccattgccttcaaaaatccagcattcagtcacggaattgtcaacaaattgacgatcatggctgaccagaatcaccgtacctgtatagccatcaaccaattcttcgagtaattccagcgtttcaacgtcaaggtcgttggtcggttcatcaagaatgagcaagttgctcggtttcaggaacaggcgcgccagcaacagtcggttacgttcgccaccagagagagcccgcacaggcgtcatcgctcgcttaggatggaaaaggaagtcctgcaaatagcccagtacgtgacgggagcgtccattcaccatcacttcctgcttgccttctgcaaggttatccatgaccgttttgtccgggtctaatgcggcacgatgctgatcaaagtaagccacttcaagttttgttccacagtgaatgcgcccactctctgacgacaaatctcccagcatcagtttcaataatgtcgttttgccacaaccatttggcccaactaaagcaattttatctccacgctgaacttgcgccgagaaattcttgaccaatgttttatcaccaatctggtaattcacattttccatttcaaacacgattttaccggaacgtgtcgcttcttcgacctgcattttcgccgtacccataacattacgacgatcggagtgctctacacgcaacgctttcaacgcccttacccgcccttcgttacgggtacgtcgtgctttaatgccctgacggatccagacttcttcctgagccagctttttatcaaattcggcattttgtaattcttcaacccgcaatgcctcttccttgctttcaaggtatttatcgtaatttcctggccacgaagtcagtttcccgcgatctaaatcaatgatgcgcgttgccatactgcgaatgaatgagcggtcatgggaaataaaaacaaggcttccgttgaagtctttcaaaaaattttccaaccactcaatcgtatcaatatcaaggtggtttgttggttcatcaagaaacagcactctaggcgagctgactagcgcccttcccaatgcggccttgcgcaaccagccaccggaaagtgaggacaattttgcttctgctggcaaagaaagttgtttcaagacatcactgatccggctatccagtaaccaaagtccctgaatatccagtacttcctgcaattctgctagccgattgaggttcttgtcactaggatcagtttccaccagacgggaagcatgatgaaatgccttgatgcaatccgcctgttcctttaccccttccgacacaaaatcaaataccgtgccttctacatcacggggtgggtcctgctgtaaacgggcaacaatcaaatcctgctcataaataacttgaccatcatccaatggctgctcttttgccagtacgcgcagcagggttgatttccctgctccattgcgaccaaccagacacactctttcgttttcttctatatgcagttcagtattatccaacagtggcgcatcactgaatgataaccaggcaccggagagattaatcaatgacataatattatttttcctcgccagcgtgacgcagtagccagcagttatgaatctggcggttacgggcaaaatcctgagataccgttttctctgtgatttcttccgcaaccagccctaatttctcaagttcggcaaagtccattttgaaacctcgcttattgttggagaacatcagggttccgccacgacgaagcagacatttaagctgtttcatgagtggaatgtgatcacgctgaacatcgaatgagtcttccattcgcttagagttagaaaatgtcggaggatcgataaagatcaaatcgaattgctcgcgactttgcgccagccatcccaaacaatcagcctgaatcaaacgatgctggcgtccagacaagccattagcctgtagattcttctctgcccattcaagataagtacgggacatatccaccgtggtcgtagacctcgcaccgcctaatccagcatgcaccgttgctgaaccagtataggcaaacaggttaaggaaatctttcccttggctcatttcacccaattttttgcgggcaatacgatgatcaagaaacagaccggtatccagataatccgtcaagttgacccagaatttcgcaccatattcgttcaccaaaaagaattctttcttttcggccattttttcatattgatttttgcctgtttgacgctggcgggttttcaggatcagttgattagatgacaattcgagcacattcatggttgcactgatcacatcgaataagcgttggcgggctttgttggcatctacggttttaggtggcgcgtattcctgaacgacaactttgtccgcataacgatcaatcgcaacgttgtattcgggtaaatctgcatcatataaacgataacagtcaataccctgctgctttgcccacttactgagtttcttctcatttttgcgcaaacggttagcataatcatctgcaataccggcatccagtgattgcggtttgtccgaaagttgataatttttctggacacaatccagtgggccatttttagccttaaactcgcgttcagcgcgcagttgcaggcaactcaacaactctggcgaagcactgaataatgagagacgccagcctgggaagcggcttttcattattcgtccaaatatgctgtgcaaggcaaccagtgctggctcactttcaagacgttcgccataaggcgggttgctcagtattgttcccacagcgccctccggcaatgggttttccagcttactcgcatccccttgttgaaactgaattaagtgggcaacgcctgctctgcgggcatttgagcgagccatatccatgacccgacgatcaatatccgaaccaaaaaagcgagaagtcgtttcctgtagccctttacggaaacgtacctgcgcttcagccatcatttcacgccagatttcttgatcgaatttcagccatgatgtgaatccccaatgctgacgatgcaaacctggagcgccatctgcggccatcattgccgcttctatcaataacgttcctgaaccacacattggatcaatcagcggcgttcccgctttccagccagagcgcaaaacaaccgccgccgcaagtgtttctttcagcggagcttgaccagccaaatcacggtagccacggatatgcaacccttctccactcaaatcaagcgacagtgtcgctttttctttgttcagaaaaacatcaatgcgaatatccggctgttgtttggcaacatcaggacgttgctttattttacgtacaaagctatcaacaatggcgtctttcactctcagggcgccatattgtgtgtttctgatttcctcattcgtgccactgaaatgcactgagaatgtgctatcgacggaaaaaatttcgctccagtcaatagattgaaccccaagatagagatccaaatcgctataaacattgaattcgttaagcggcatcaggatacgtgatgccagcctgctccagagcaagcttttatacatcacccgatcatcaccttgaaaatgaaccccaccttgggcaatcttgcaggattgcgctcccagcatttccaattcgttttttaataattcttccagcccacgtgccgtgctggcaaagagagagttcatattatttttcaccacaaaaagtccaccaccaaaaaaaatcgctgcacattatagctaataccagcaacatgtcataaagttgctcaccttatcaaaaaataaaaaacattttttgggcatactgaatgataactctgtcacgtctctatacatacccagtgaaatcaatgcgtgggttgcagctctcgcactcctttaccggtgaaagtggtttgatgtttgatcgcaactttatgattaccaaaacagatggcagtttcatgacagctcgcctgtatccccaaatgctgctatttaccccttccatgctcaataacggtatttacttgagagcgcctaatggggaaagtgcaacgatactctacagcgattttaaagaagaacgccatcctaccgaagtttggggcaatcattttactgcgttggtcgctcccgatgaggtgaatacctggctgggtggcttttttgatacacctgtgcaactccgctggctcagtgaagagttaacccgccgagtgaaacaattccctgatatctcactgtcatttgctgatggttttccctacttaattattaatgaagcttcttttcatgcgttgcagcaacgttgtcccgccagtatcaaaatagaacaattccgtgccaatattgttgttacaggcgcagcacctttcgaagaagatagctggcagaccatccagatcggcaatattatttttgacctgccaagaccatgtagccgctgtattttgactacagtaagcactgaaaaaggccgtaaaaatccgaaaagcgaaccactggctacattgcaatcattcagaactgccaaagagaatggggcagttgattttggacagaatgccattgtccgcaataatgggattattcgcgtaggtgatagcgtcactattttagagaagaaaacacctcgtgaatatggctgcggtgagcaagcaaaagatttgaatatacagaaagcaattgggcaagctatttcaattgaattcaacggtcagcgttttactggaaataatcagcaaattattttagaacagttggaaaaacaaggtattaaaatcccctattcatgtcgcgcgggaatttgtggttcctgtaagatatctctgattgaaggtaatgtgtcaccattaaaatcgaccgctatcaaagataatgggaaaattctggcgtgtagctgcattccccaaaatgatttggttattgaattaaactaaatataaataatatatattatttatatttacatagctaatcaggctgtatggataaaaacatctgcctgattttttatatccaatagtactggcattcagctatgccgatcgtttcaacgtggactgtcattgaaaaatctaagacaggaaaaatattttgagatcaaagactcaatttaaacaaaaaatgttctgaatgttactgttgaatggtgataaatgacaagtgatattaacaaaatggcttaatatattaaatcgctctgccatatatcgtttcccgagtgggttcagtataaggcattaaacggtcattcattatcttaattggatcacaaaaattcatcactcgatcattaagttctaacttttgttgtgctaataaacacaagctggcgctatcaccgacttctgccaccatgaatagcacttcagtaccgcaatcctgtaaacgaacttgaacaatttccccctgttccggttttgtcattacagagaaactggaaaaataccagctttttggcatttgtggtttcataaaacggaatgcaactacgccattcaatgctaattcagcccggagctctgatgcaatattaatacaacggaaatgttcttcgaaagcataataaagtgctgcatcatcgacagaaaaaggcatttcttccatcgtgattgcataatcagtcagcattttggcaggaaaacgggaacggaaaaccatgccattagcgagatcgagcatgacacggctgtgctcggaatcaaagtaccagcgccactgatcatcaggtctaattttcattgattaccctttatatgctcaaaatagcttgtttggttcaaaataaataacactaccatagtggaaaaccagaaaaactgataaaaaaattaatctatcagacaaaatatagacgagttgagagtagaaataaacccccaactccgaattgcggcaaatattcagatatgattaacaatatctttgattagttttggccctttatagataaaaccagaaaatatctgaatcaaagaagaccctacttccattttttctctagccgcaactagggaatcaattcccccaacaccaataatgggtattttaccttttaattcttgagaaaagcatcgaattatttctgtactgcgaagttgcacaggacgaccacttaatccaccagcctgctggcagtgattcaacccttcaatgagctttctatccagtgtggtattagtagcaataacgccatcaatgcgatggcgcattaaactgtctgcaacttgtattaattcttcttctgtcagatctggtgcaattttcacagcaatcggaacatacttttggaatttctgctgaagttcactctgcttatttttaatcgcagataagagatcatccaacgcttcaccatactgtaacgttcgcaaacctggagtattgggggacgaaatgttaatcgtaatataacctgcgtgaggataaattttatccatacaaattaaataatcgtctttgccattctctattggggtatctttatttttgccaatattgatcccaataatcccatcgtattttgcccgtttgacattctcaactaaattatcaacaccaaggttattaaaacccattcgattgatgatgccttccgcttcaacaacgcggaacaatcttggtttgtcatttccaacctgtgggcgcggtgttaccgttccgatttccacaaaaccaaaacccattgcaccaaatgcgtcaatgcaatcaccgtttttatcaaggcctgcggccaagccaagaggatttttgaaagataagcccatacaagtgacgggtttagtggcaactgactggcggataagaaattcgaaaggagtaccggtaacaagtttgagctggcggaaagtaagctcgtgtgcctgttcgggatcaagctggaacaatgccttccgtagtagcgaataatacatgcaatctcctgcgggcgtaatgacaggtcggggcgactgtgaaataagcgccgagcatcttaaagagatcctgtcaaaatgtaaatgtgcgggaagatatttttcaatttgctggcaaacatcctccggccaacgccggaggaaaaacgacaactcagctctcaagcgccttggtgattttttcaaataaatcaccggacaggttttctaacactttcaactgctccagagtagcacgcatcaaggactggcgtgcctcatcataacgtttccaacgaatcaacggttcaatcaaacgtgacgcaacttgcgggttccggctgttcaattcagtcagaacttcttgcaggaattgataaccacggccatcttcagcatgaaatgccacaaggttattagcaaaaaacgttctcagcaacgaataaacccggtttggattactcaaactgaaagaacggttgttcatcaagctacggactttatcaagtgcatcgaaagcgggattagttgcctgtagggcaaaccatttatccatgaccagaccatcctgatgccagcgctgctcaaactcatccatcaattggtaactgcaaggcaactcagcagacatagcggcagacagcgctgcgacggtatcggtcatattatcagcttgataatattgtgccgccactaattgatccacctgttccttgtcatcaatgaaggccagataatagaggcaggtattgcgtaacgcccgtttcgcaatatcttgatgatcaactcggtatgcacctgtgtgaatactgtggtaaaccgcagtgaattcatccgccatttcgttggccaatccacgcgttattgcatgaagcacgtcatgaatggattttggatcaatcactgtgaacaattctgccatttcattttcagacggcaaggtcaagatttgtgctgccaatgccggatcaatatcttgattcaataataccgcacggaaagcatcaatcacatgcattggcaactccaatgtcagggattgctgataacgggcaacattcagtttcacataattagccagcagtgactgtgctgcatcccagcgggagaattcattaagcgcatgtttcatcaaaaatgccagttgtgtatcactgtatgggtaatccagtttcactggcgcagagaattcacgtaataaagaaggaacaggcaatgatggcacatcatcaaacacaaacgtctgttctgcattgatgatattcaaaacatgatgtattggctgaccatcacggcgtaatgggatcacactgccgtgctcatcataaagctcaatgtccagagggatatgcagcggctgtttctctttctggtcagacgttggcggtgtcatctggctgacatgcaaagtatactgctgtttttctgcatcatactcatcacgaacggtcagtatcggtgttcctgactgactgtaccaacggcggaatagcgtcaaatcgacgtttgaagcatcttccattgcctgaacaaaatcatcacaggttgctgcactgccatcatgacggtgtacataaagctgcacccccgcctgaaattgttcttctcccaatagtgtgtgaatcatccgaatcacttccgagcctttttcatagacggtcaacgtatagaaattattcatttccatcacttggtcaggacggatcgggtgagccattggactggcatcttcggcaaactgagctgcacgcatgatacgcacgttattgatacggttgaaagatcgtgagcccaagtcagagctgaattcttgatcacggaataccgtcagcccttctttcaggctcaactggaaccagtcacgacacgtgatcctatttcctgtccagttatggaagtattcatgaccaatcacggcttcaatgccaagataatctttgtctgtcgcggtttcggtttttgccagaacatacttggagttaaaaacgttcagccccttgttttccatcgcgcccatattgaagaaatcaacggctacgatcatgaaaatatcaaggtcatattctaaaccaaagcgagtttcatcccacttcatcgaatttttcagcgatgtcatggcccaatcggtgcgatccaaattaccacggtcaacaaacaactccaacgcgacttcgcggccactgcgggtaacaaaagtatcacgcaggacatcgaaatctcccgcaaccaaggcaaacagataggcaggttttgggaatggatcttgccacttcacccaatggcggccatcactcagctctccctgcccaattcggttaccattggacaacagatagggatatttggatatatctgctgcaatacgggtagtaaaacgagccagaacatccggacgatccagataataagtgatattgcggaaaccttctgcctcacactgagtacatagagcatcgccagatatatacagcccttcaagcgccgtgtttgctgatggataaatttcattcacaattgtcagggtgaactgggctggcaactgctcaatggataatttgccatcctgctcgtgataatgttcccacgccttatcgtcaatatgaatgcttttcagagtgagattttctccatccaaaatcaatggagtagtatcatggttcaagcgttttacttgactgattgccgtcacagttgttttatcggcatgcagatcaaagtcgagatcgatgtccgtaatcgtgtaatctggtgcttgataatccagacggtgtttaacgagtcgctgttgtgtcatagggaacctttttcattacttttaatcggcatattgataacatctgtataacttcagccataagatgctagcatactccgtttccatagaaattttccaatctctaacgctgccatagagattccatcctttcaatcatgaaacctcttttttcggatgttaatcaattattaaataaaggtgtaaatgatgtaagcaggatattagtactttcgtgcaaattgtcatctcatatctcatgtaacatgatattatctgcagatggattaaccttaatcgttactgtccggaaaaatatatgcggttatgtggctttaataacaaaataatcacggtatactcttccgactttatcgatttagcagacacgaatatgctccgcgaggatgcctaacgcgccatgactttagacgctaccccgattatcaaatcactgcttgatactgatgcctataaatttcatatgcagcaagcagtgtaccaccattacaggcatattcctgtcgttgcggaatttcgctgccgtggtgatgaactgctcggcgaatatgccgagacgttacgccatcagattgacatgatggctgatctaacactgacagaacgtgaagctaattatcttgccagccttccgttctttaaagaggattacctgaactggttcaaatcattccgttttaatcctgaacaagtcaaaatatccgttaccgatgaaggtcaactggctatccgtatctcaggcttatggcatgaggttattctgtgggaagtccctttattggcactgattagcgaactggttcatcgccaccgttctccggaaataaaaccggaagtggccgtcagccagctcaggaaactgattgagctattccatcaagacgcggctgaaaaaaatatcgatctggccggtttcaaactgatggactttggtacccgccgtcgtttttcacacgaagtacagtatgccatcgtcaatgagctgaaaaacaatttcccttatctgatcggaaccagtaattaccaactggcagaacagcttagtctggctcctcttggtacacaggctcatgaatggtttcaagctcatcagcagattagcccggagcttgctaacagccagcgagcagcattgcaaacttggctgaatgagtatccagctcagctgggcattgccctgacagattgcattaccatggatgctttcctgcgggattttgacaaaacctttgctaccgcctaccaaggcctgcgccatgactccggtgatcctatcgaatggggtgaaaaagcaattgcccactaccaatcactgggtatcgacccaatgacgaaaacactggtattttcggacagtctggacttgcagaaatccttgaacctgtatcgccgtttccacaagagaatcaacgtcatgtttggcattggcactcggctgacctgcaatattccgggggtaaaaccactgaatatcgttatcaaacttgtggaatgcaacggcaaaccagtggcaaaactttcggacagccctggaaaaaccatctgtgaagatgatgaatttgtcgataggttacgtagagcgtttgacattccctacatagaaaaagcagtataatcttcgttaattgtcccttgcgtaaccagcttcatgctggttacgcaagtaaaaagccgcttttccctgtttttccccattcaaactcacaatttctgcttgtttcctgagatatggcaagtaagatagaagatctgctcctgatggagcatttacggtaaatctatctaactatctaattcactatataaagaagagagaaatttatgagcgttgcgcctgtagtcgatgtactgcaaggccgcgtcccggttgacagcgaagtcaccgtccgcggttgggtacgtacaaggagagattctaaagctggtatctcgttcctcgccgtctatgacggttcctgctttaatccagtacaggccgtcgttaatagtaatttacctaattatcaggatgaagttctgcatttaaccactggctgttctgtggaaatcaccggtacagtcgtggcatcacaaggcaaaggccaaagctttgaactgcaagccaccaacgtggttgtagtcggcatgatagacgatcctgatacttacccaatggcggccaaacgccacagtatcgaatatttgcgtgaagtcgcacacttgcgcccacgcacaaacctgattggtgcggttgctcgcgttcgccatacactgtcacaagccctgcaccgttttttccatgagaaaggcttcttctgggtatcttccccgctgattaccgcatcggataccgaaggcgctggcgagatgttccgcgtttctacattggatctgcaaaacctgccacgtaccgataaaggcgacgtggatttcagcaaagatttcttcggacgtgaagccttcctgaccgtatcgggtcagttgaacggtgaagcttacgcctgtgcattaagcaaaatctataccttcggcccgactttccgtgctgaaaactccaataccagccgtcacttggcagaattctggatgcttgagccagaagtggcttttgccgatctgaacgatatcgccagtcttgccgaaaagatgctgaaatatgtcttcaaggcagcattggaagagcgtgctgatgatttagcattctttgcagaacgtgttgacagtgaagttgtcagccgtttagagaaatttgttgattccgatttcattcaattggattacaccgatgccattgaaattctggagaattgtggccaggaattcgagaaccctgttttctggggggttgatctgtcatcagaacatgaacgttatctggcggagaaacatttcgaagcgccagtgatcatgaaaaactatccaaaagacatcaaagccttctacatgcgtatgaatgaagatggcaaaaccgttgcggccatggacgttctggcaccgggcatcggtgaaatcattggtggctctcagcgtgaagagcgtttggatatgctggatcagcgcatggaagaaatggatctgaataaagaagattactggtggtatcgtgatctgcgccgttatggcaccgttcctcatgcgggttttggtttaggcttcgagcgtctggtcgcttatgtgactggcgtgtccaacgtgcgtgatgttattccattcccacggacaccaagaaacgcaagtttctaatgaatcagctcaataattgggcaaaaattaatccattgaaaagccaacgaaagttggcttttttcattttatggttcaagccggacgaaaaaagttccctaaaatttacattttgaaatatctatttacaaattgttaccaattattcgattttgtagcattttgagggtagataaaattcattaccaatggaacactggtcgccgactaataagacactcaatgtccataaatagttccaaaaatttttagtgttctatttctggcagtggccggtgtcaacataacaccaatgagggtaataataatgaaacgcaatcttcttgcagtggtaatcccagctctgctggtcgctggtacagctaacgcggctgaaatttataacaaagacggcaacaaaatcgacgtttacggtaaagtagacgttcgtcatatgttcggtaagtctaaagactacaaagcagacaaagaacatggtgatgattcccgcgcacgtctgggcgttaaaggcgaaactcagatcaatgatcagctgactggttttggtcgttatgaaaccgagtggaaatctaacggtacagaagcagcaggcagcggctataaaactcgtctggcctacgctggtctgaaatttgccaactacggttcactggattacggccgtaactacggtgtaatttatgatactgctgcatggactgacgttctgcctctgtttggtggcgattccatggctcaaactgacaactacatgaccggtcgttctactggcctgttaacttatcgtaacaatgacttcttcggtctggttgatggtctgaactttgctctgcaatatcaaaccaaaaaccacgaaaataccattaacgatcgtaaaaaattatcagaagctaatggcgatggttacggcctgtctacttcttatgatgtcggttacggtatcactctgggtgctggctattcaaactctgcacgtaccaaaggccagaaagattctgaagcatcaggtaaacgtgctgaagcatgggatatcggtgcaaaatatgatgccaataacgtttatctggcagcattgtatggcgaaacccgtaacatgactagattcggcaaagatcttattgtcgaagacaacgattttggcaaaagcatcgctaacaaaactcagaacattgaattggttgcccagtattacttctctgacttcggtctgaaaccatctctggcttatgttcagtctaaaggtaaagatctggatctgggtgaaagtgaaaacagaaacaaccaagatctagttaaatacgtttctgtaggtacttactactacttcaacaaaaacctgtctactttcgttgattacaaaatcaacctgttgaacaaaataagttcactagaaacgcaggtatcagcactgacaacgtatttggtgtgggtctgacttaccagttctaattacagttgatgaattgtttagctcaaagttaaacaaaaccatctctgaaaagcagcgcttaggcgctgcttttttacgttttactttactgttttttatgacctttttttcactccgtaaactacttcacaagattgtcttctttttgctacaaattgttggcaaacgagtttcttggagttaccctgagcagcgtataacttattttttgggcttaactctccgagtcttggaatcaaaaaaatgtttgaaaaaattacagcagcacctgccgaccctattcttggtttagcggatagctttaaagctgatcctcgtgaaaataaaatcaatctgggtatcggtgtttacaaagacgaaactggtaaaacccctgtcctgaccaccgttaaaaaagcagaaaagctcctgctggaaagcgaaaccaccaaaaattatctggcgattagtgggttacctgaatttggccgcgtcactcaggaactgctcttcggcaacaccagcgctatcattactgacaaacgtgcccgtactgtacaaagcccgggcgggaccggcgcactgcgcactgctgctgattttattgctaaacagaccaatgcaaaacgtgtctggatcagtaatccgacatggccaaaccataaaggcgttttctctagcgctgggttagaaatccgcgaataccaatattacaatgcagaaaagcacgctctggattttgatggcatgctgactagcctgtctgaagctcaagcgggtgatgttgttctacttcacggttgctgccataacccgaccggtatcgatccaacggctgaacagtggcaaaaactggcagatttatctgcggcaaacggctggctgcccgtgtttgatttcgcttatcaaggttttgccagaagtttagatgaagatgcagaaggcctgcgtatttttaccaaaaaccataatgaactgatcgttgccagctcttactccaaaaattttggcctgtacaatgagcgtgtaggtgcctgcaccatcgttgcaactgacagcgataccgcagaaaaagcattcagtcaggcgaaatctattgttcgtactaactactctaacccaccggcacacggcgcttctgttgttactgcaattctgtctaatgacgaactgaaagcagaatggatccaagaactggcgactatgcgtgaacgcattcgtcgtatgcgccagctgtttgtgaacaccttgcaggaaaagggtgcgaaacaagactttagctttattattagccaaaatggtatgttttcattcagcggtctgactaaagaacaagttgaccgtctgcgtgaagaattcggtatttatgcggtcagctctgggcgcattaacgtagcgggcttaacactggagaacatggttcctctgtgtgaagctattgttgcagtactctagtttttctgagtaccaagatctccctcaatcacaaagccgctgaaaaagcggcttttatcttccgagcaattaaaaacgcatcaatcaatcttgcaggaatggattagttttacgttcatgacccaatgttgacatcggcccatgtccgggaataaagtggaaatcatcacctaatggaattactttttctttaatggattgaatcaaatcatcataattaccacccggaaaatccgtgcggccaatactgcccttaaacaacacatctcccattgatattaatttatcggtatgattgacaaagatgatatgccctggtgtatgccctgggcaatgcaaaacagagaattcgatattaccaatctgcaatgtatccccttcatccaaccagcgttctggtgtaaaagatggacatgcctcaacaccaaacatctggcattgaacttccagcgcttctatccaaaaagcatctgctttatgtggcccatgaacaggaacattgaagtatttagcaacgtcaacagtagcgccaacatgatcatagtggccatgagttaacagaatttgcgttaatttcaatccacgtcgctctatttcagaaataagtttttcagcctcaccaccgggatcaacaattgccgcttccagagtttcctcacaccagatcaacgtacaattttgcatcaccgtagttacagggataatgtggtaattcattatattgtttaactccacgatcaagacaaatgcctgataataagattaccacgtcctgactgggcctgtatctatatgaataaaattactctttgggtaaaacccaacgccccccgctctcatcttcagtgcagctttacgaatatgcgcgagctgaacactatcgatatgaaaatccattgcttgcccacgggtatgatagctacgttttgcgacaccaccgctagcctgacgcaacatattatttgtcgccaatgaacgataaccagacaccaattgaacaggtttatttattcctatcatcatttgcaataaataaatctgatcaaacagtttcggatcaatagatttgattttattttggcgataatcgcggaataaataattcaaacgagccaattctgacttgttataacggcgaccatcaaaaaattctgctttgagtgtttcccccgtgtgcaaattatcaaaacgtaaaattctaggacgtggcgttgtcaatgcggccaatgcgtgttgaggtaataaacttaaccccaacgcagctgcacctacaccaagccactttcggcggctatagtcaatatcattcatggattaatatgccctgctattctatgatgtattaataatttctaaactaggtgactcattgagtctaaccgactaataagacagcaacaaacaaaaagtagtttcaataatttttgtatattactgtaaatttaccagtcagtaattgtgaccaatctaacataataaaaataatattaaacatagatgaaatattaatgatgtcgtgttattacaaaattttatccatctgaatcatgataaatttttcaatagcagagaaaaaaatcatattaagaaaaggtaatcataaggaaaaatagagtcaaaagactggataaggagaaaataacagtgaggaaaatagcgctatttccctcactgtacagatattaattttaaattttcttctttcattcattatagaaaattataaatcatttcgagttgccaggatctcgggtaaaagctcagattgctctctggcactcatatcataatcataaatatctgcgcggtattgaggcactcctccttcatcaacccacgccgtttgataatagagaaataccggaattttcttcggaatattcacatatgctgttgtccacgtttttaaggaattacttacccgatccttattccaacctgcattccccaacaacatattagccaattcaggagccttattaacacgtacacaacctgaactgaccgctctcatttcccggccaaatgaagcctgatttggcgtatcatgcaaataaatcgcttctgagtttggcatgttgaacttaaaacgccctagtgaattagttggaccaggcgcctgccgtatacgataaggaaaattatttggcgtagtcacttcccagttaattgatgaaggatcgataaccttggcatcattgctccaactggaaaaaacggtataaccacgactacgaaaataactagggtcacgcattgctctaggtgcaatatccttccgtgtcatactggtaggaacagtccacggtggattaatcaccacattattcagctcactgctcatgataggcgtttttctgctcggtctcccgacaacgactttagaattcaatacttctttaccatccaggtaataaaataatgagtagttgggaatattgaccagaagacccgtaggaatattacctggaataatacgcagcctctgtatattcaatgccataattcgagcgcgggtttgtggcgtagtattcagccatactttcgtcgactgtccaataacaccatcagccgataatccatgtaaagcttgaaaacgttttacggcagccactaattctttattgtaaaccttgttttcaggtttgactgttaacgaatccaacgtatcggaacgaattaatatttcccttaacgccacaacactttcactattttgccccggtcttaatgttcctttcattgaaaattcagacaactgttgtttatcagccaattgtttcagcatctccttacgcatatttttatacatagggttatctggtgataacgcagtgatgtaagaaagtacatgattatcagtaatatgctgttgccatttatcaattaaatcagaaggcggtaaatcaagcttataagaatttttactgtataaccacggctccccttttctcttaacattattgacaaaatgcagataacccaacatggcatctgataagataatatcacgccccatatcacttaattcagcagaatgaagttgagtcagccactttccaaactggggttgaaccccggccaatgatagttcaaataattgctgttcaaactgttgaaccgtatttttatcttgccatagcggtttcattttattgactgcatataacgttgccaaacggtcaatgaatattggttttacttgttgcggcaaccaactttgtatctgttttcgatttgcttcaatagaattcactgcagatataggaataatctgatccggtgaagcaactacgtctttctttttttgttcctctgaaaattgttgggtatcatttactatcagtccattttgttgacttgcaaaggttccctctgataccgccaacgcgctacagataaaagaaactttcagtaaactgaccgtgttcttcgccataagacctcaccttaccttattatgcatgcagctatccaatgacttattttaattatcggtagacttgttttatcgagaaagaatagtggtaattatatacataattatctattaagatagaagcatatcatcatagccagtcacctcgggtaaaaaaaagtttttattataataaattagcttatgttagcactaaaaaagaaaaaggcaccttaagtgcctctaactaaaattcattctgtaaaatttttcagattaatactcggatttaatgactacttcttccccaaagcggccagctttaggcaggggctgataagaagaatttgatgctctcagaatacgaatacctctgatattcagttcatgcgcagcagcaatatcagcatctgcatcaccgtagtagattttcagtttatgatttttcatccaactgactttatcattcttacttggctcatcacctgcgaaaataacggcgtgcattttatcggccggaatgtgcaacccttcctgcaaatatttagtgacggtttctgttttggtttctgtacgccctgtaatgaaataaatatcatcaccgcgttttaagtgcatctgaaccaattcaatgccaatttgtttcggcatactgaatttatcccactcattattcattttttcccaaaatgctggatttttcagataacttttgtcatttggtgaatacttcaatttaccacgataaaaaccaggactggaaaacaatacagtgtcatcgatatcaaaccctacagcaatggggggctgattctgcaaacttttatcaatctgcgctactgagacccaatgcacagcctgacgctgggccaaatctacggttgttactcctgagctaacctgctcaggcataaacatttttgcctgagccataccattcaggccaaaagcaagtgcaatcgcacttaatgctaacgtcactttccgcattgttattccttactctatattgattacagcaacgtgaaataataaatgttcttatagaatcaaaatgagatataccgcacaataatctaatgttatttctgtgaatgtaattattactttttatgtgtaaaaaacagttcacctattatacagaaggagattcaatttaaataattaataaattttcttagctctaattcttttctttttaaataataaatataactaaatgtctcagacgaaaataatgtatttgggatgattttaactccaacgctatttaaataatctacatttaaaatagaattattgattattgaatacccgataccaaaacaaacaaactctataatatgacttatatcaggaaaaaccaacatctgagtgttaattttatgttcttttctgtatttcaacatttcatcaaagcatggatgctttgttgttccagagtggagtatcattttttcattacgaaccacattagtcaatgaattatttttattaaataacgattttgatatgataaatacctcagtttcacgttcatgtactttatatgtaattcgttctaatttatcttctattggtggatgagtggagataaaaaaatccaatttccctgaaagtaatttaattctatgttcatcaaaataatacatttcactcaatagatcaacatattcattttcaataattttacttaacaatttcttgaacgcctgattataactgtctgttcctacttttatttctttttctgttagtatggttggtaaacttgatttaatattttcaacatcatcacgtattggtagtaaatatttatacaaatttacgacttcttctgtcaaagtcacacctacattagagcgattaaataacttgaaccctaatgtatcctcaatgtcagcaatacttttacatagtgcaggtgggcttatatgaatatttttagacgcatttttaaaagatccgcattcggcaacactcaaaaaatgatttattttttttgataaaatcataacacctcacacattaaaaacaaaggtttaacaattatgaaatgtaaggttatataatctatactgaggtgtcaagttggtgatttaagcctaaattatccttttcactagactatcttaatttgtataaaaccaataaaaaacatctattggtttaacttttaattaatcaaactcaataaaatttgaattgattttaacaacgatagatatcatttttaaactcaaaatcatcttatcttttgattgcaaaaaaatattattacaaaagattcataatacctaaaatagaaatattaccaagctgatattttcttataaaacaagataaataagaggttagttaaaaataatttacaatcataatttatttttaaaataaatatattaatcaatcaatttttataataactagaagtttttactgaaggagtatatcgtgacaaattctgttcatagaaatgaacatcagaaacaaaataactcaccaacccatgttgaatgccatacagaatggggaaaattacgacatgttattgttggtcgtgctgataatgcttgtattcctccgccagaacccgcatttatggcacgtattccagaaaattcggatatgcgtgggcgttatggaccaagaagccaagaatcaattgacgcagccaatgagcaactggatggattagcatcaatattaacctcgcgtggaatacgcgttgatcgtccaacacccttggatttcaattctcctgtgcaaacccctgatttcactcaaggaacaatgtttggttgccagccaccaagagacgtgctgattactgttgggcgggaaattcttgaagcaacaatgagtttcagatcccgtttttttgaatacttatgttatcgaccgcttatttcaacttatttgaaagaagatggaggaatgcgacacgaatcggcaccacgcccccgactatcagatgccagttatcggcatggttatttatcggaagcaatcagcatgaaaacccgaaaggaatgggtgaaaaaaaaagaatttgtcacaacagaagaagaacctatttttgaagcagctgacattttccgatgtgggaaagatcttttcgtacaacatggttttaccactaatatgaaaggggttgattggctaaaacgtcatttctctgattatcgtattcatccaatcaattttcctggtgatccttttccaagtcatattgattgtaccttactgcctttgcgccctggtttgatcttaagtaatccagtcagacctttattacctgaatttaaacagttctttatccataatgactggcaaattattgaagctgcatccccagcacatagccaatcaccgccattatgctattcgagtgtatggctttcaatgaatctcctgtcacttgatgaaaaaacagtatgtgttgaagaaaccgaaattcatcaaatggaacaattggataaattaggatttgaaatcatccccattccttttcggaacgcatatccttttggtggaggattacactgtgcgacaaccgatatttggcgagaaggaaatcttgaagattatttccctgcagaaagttatttatgttaaataataatattctttgcatatcagtaatgcataaacaatcttatttttgtcatggatataaaaaccatacctagagaatctggaatattccaatgaataacatagaattcaacacatcatttttaaaacaatcgccaacctcctttcataacagagactttcagtattttttgaaaagagtacccgaagattttttagttgaagaggtaccgaaattctataaaccttctatgaaaaaacagatctggcatttccaattatgcaaagaaggcatgacaacatctgaagcaattacgaacatttccaacatattgggaataccggaaaatcatattggctatgccggattaaaagatgaagatggagtaacaagccagaggatttctattcaatccttaccgaataatgtagatatcaatgccatcaattcccgtttagatatggtatcaggcaaatggctctcattacataaaattggctgttttgaagaaaatataaagattggccagttagtaggtaatagttttcgtgttgttatccgtaatttacataatcatattgctcatacattggcaaaacaatcatcacacaaccatgcttttattaattattatgatacacaacggtttggtgtacccggagggccatctaccacacatcttattgggcaatctttccatcaaggagaatgggaaaaagcgttattattagtacgtgaatcggcttctccagaagcacagacagcccaaaaatggcaaggcaagccagtcaattttttccatcaattagatcccagacggctctctttttattacgcttcttacggatcttatcaatggaaccatcttgtggcacaagaattccaacgagatcatgaagggttacgggtgatacgctcatcaataccctatattttgcccaatgcttattctgacattatggcatttgcagcagcgatgccctggtatccatttagccggattgaaatcattgatggaaaaaaaacagaaaagcaaagcctgcgtcctacagttgttcatacctatgtaaaaattgtcgaactcactgatgatcatgaatttcctgatcgttccagtttgacggtagagttttttcttccatccggctgttacgcaacgatggcaatctgccaatttgtctatttagcaaatgctcataccactctttagcataggagatttgcacatgcgtatattattactgatcccgccctatattccttcctattttaatgcaggtcatcacctacctttatttcaagtcgcaacttatatcagggaaaaaaatccatcttggcaagtcacggcactagacggtggcacacttaatctgacttggcatgatttagccaaagaattggcaaaaggttataattttattggtttatttaatgattttgatgcagtagatgggtttggccgtactgtcatgtattgtcgagaaattttgccgcaggtaaagatgtttactttcgggcgactttcaaaacaggttcctgactggttcaaacaatttggctttgaaggtattgctttcagtggtgattatgaaagcagtgtcgaatcttttcttttaaattatggccctaatactggcagtattcccggccttatagtgaaaacaccagagggttatttacaaggtaatgccggccatatgttaagcccggaagagtggatattacccgatacactggaaatcccctacgccgcttatgatcgaatgtataaaaacgatttgaataaattctgtggtattcctgatcgacgtgaactcgttattcctgtcgcccgtgggtgcccggttggttgtgaattttgtgatgtaccatcaatgcagggaaaaagtgaacgacggctctcagttgatcgcgtgattaaatatataaccgaccaacaacagattcagccatttgattacatctctttttatgctcccacttttacattgaatcgccgatgggtaaaagagttatgtcataagttcatcgagttgaaattacctgttaaatggaaatgcgttaccacaatttatcacctgaatgaggaattgattgcactgatggcgcaagctggctgtataagaatcagccttggtgtagaaaccatttcggtttcgcaaaatttacaattgccacgaataaagctgaatacagaagccaagattcaagaattattggcaatcgccaaacataatggaatagaaatcaacgcattcattattcttggattacctggcgatacgatggaggcttcaatcaaaacaattgaatggttgatcgcagaaggcgctagagtccgaccaaccgtctacaccccttataatgaactgcacgaaggctcttcacttgcagaagtcggtaaatacaaccgccaaatcttccatgaaacaccccaatcacccatggaacgcctaaaaggctattcattgctatttgccaatgacaaagatcgcccgactgaagtgatgaaaaaaatagcgttacaggtaacagatgagaaagatcaaatatcaggaggatccctatgaatatccggcgatattcccccgattttaagcaaaaaaaagagccgtttgaatggttctgttccgatcgttttttatccccaaaagttttcgcacggttacagtcagaattcccacaaaacggttatcgtaaatctcatcgtgaagaaggtgatgaaaaatactatagcacttgggatctattggccattgataatggtgtccctgtcttggatacatggaataacctgacaacggcctggaaatctatgttgataaccattctgagtgaaggttatcgcaattattcttcaacattgacggggcgtgatctcacagaaacccatctgcatgtgcgttttaccatttatcatgaaaattgctggctggctccccattgtgatcgcacagataaagtcatcacccagaccctctattttccaaccggtgccatagagggaggagaattacttattctcggctcttccgatcctgatgatataaaggaaacggtagctcctgctcctaatcgttcagtgatcctcctgccttccccatattcttggcacagtgttcgtaaagtggtatccggttcacaacatgcacgccgcgcgctccttcttcattacgttagttctgataataaataaggatagcaaaaaccatgtttaatttattactgcctgagacattgacggataccccttatcactggggaatagtatcaccatttattcacaacgatattgcaaatagcttgatggaaacttttcctgataatggctttattgttgctgagaaaatagcgggagaacccaatgataaaaaaatgtacagtctagaaacattacagcttgaaaaagataccccactttctccgatatggcatgaattcattcaatatctgcgaagcgatcaatatagagatcggatgggagcactcattggaaaagacctcagctcgacgatgttgaatttaacattatggcgctaccgttcttcccaatggttaggtccacacacggataaaccggagaaaatagtcactcaaatctttaacttcaaccggaattggtcatctgactggggtggatgtctgcgtattttacgttctgacgattcacaggatgttgatcgcgaaattccaccagaactgaacacatcagctattctgcaccgctcagaccattcatggcatatggtgacacccgtctctgatacggcgcctgtcgggacttatcgtcgcgtgctgactgctgtttttatttctaactaacattgacataagaactggagaaataaaatgcacaagattgaagtcactggtggcagtccattatcaggccaagtgcaggtatcaggatttaagcatgcatttcccccgttgttcagcctggcattgtcatcaaatcaaccatctttgatcaaaaatgtgcctgatattgcagatatcaggatattgggaaaaatcggtcaattgcttggcgccgatatagtgtatgagccagaaaagcgcgccatgtatattgatccccgcagcttgaacaatagcaatatccctggcgatttaagcgctttgattcatggagcctggtatcttgctcctggattactcgcccgtaccggccatattgtattaggtgaaaccggtggttgcaaaattggaggagggcaagaaggagaacggccaattgaacaattatgctctgttttgcaaagattcggggctacagtaaaagcagaggaaaatattattcaagcaactgcacagcgtttctcctctgcccgaatcgatatggctgattttgccgtccctgaagaaggaacggacaaactgaccggcccactttattctggcgcaaccaaagcagcattgctgtgtgcagcaagagctgaaggtatcagtgaaattatcaatccctatcctaaaccggacgttgtggcattagtggaagcaataaaatgtcagcaagttgccatacagtgggaaaaaaaccgaatcattattgaagggaaacctgaagcgggtggttttgaaactactatcgggcctgatttgatcgaagtaatgacttatctaacgctttcgacttactgccacgcgccaatttccattaccaacgtatcgcggaagcacattgaaacagggctttccgctgaaattgcctgtttggagaaactgggttatctgcttcaatggcagggtaataatctctccatcgctcatgtatccccagcttcccgattggatattcaagtcacttcccacggaatatttagtgataatcaaccctttatggctcttttgttgatggcgtctgagcagggcggtagcctaaccgagcaggtttgggttaagcgttttcaatacatcgaagaattggaaaaaatgggggcaaaaatcatacgcagtggaagaactgtagaaattatgcccggtgtccccggcaaaagtggcataacagtgaatgctaccgatttgcgtggtgccgccgctttggttatcgcagctttacagatatcgggcaaaacgcaaataggcggtgttgatcatcttgaaagaggctaccccgacttgttggggcaactgcggttattgggagccaaggtttaacgttctaattatggagtgtataaatggcagatataacatcaatcaattatccattgcctctggcccctgagcgcccttctcgcacaagagaatttctggagcatggcacaaacttgcgcagtggtgaattacatcatacagcgttgacgaagatgatacaggatattgatattcctccacagcgacaccagttttatccttacccacaaattgagcataaccgtgctgcaaaaatgctggggattgattcttcctgtatttatttcactccaggatcagatattgccattggcctgatattgcgtctgattgcacgtacaacaggcagattaattattccaatacctaactattttggttggattgatcatgccaatcttaatcagatcaacatattaccgatttatttcaatgatcaatgtactgagaatttctgtctcaaaacattattgggcaccattcaaactacaccgccatccattgttgccatttcaaatcccaatagcccgacgggcatagaatttgatgatgaaacaatattagcgatttctaactcttgtatacgacagggtcatttgctggtcattgatgagtgtttcatggcatttggcaacattgatcatttagccgttttaggccagcctgaacatatcatctatgttcgttcattctcaaaaggctacggcctagcaggtgcccgtatcgccgccgtgatagcttctccaactattattgatattttgtctcaagaaagaacggaagccgctatctcaggaagcgcttgggcagtactccaaggtattttggtaaaggaataccaaatcaaacaaatctgccaatccattattcaggcaagggaatatgtcattggaaccataatgaaactacgcccgaattggcagatccttccttccggcgccaatttcattaatgtcaaaatctgtggtgacagtcctgctcaactggtgaaaacagcagccttgggtggattttacatccgtgatatgagttcacaagaaagaatggatggatacatcaggattggtattggtgaattggcattgatggtgaaattcctcaaacaacttttcccttcggaatataaatatagtgaataacaatgagaacacatttcaaccatgtcaataaactgtgcatttgcccgatacatcatgctgatatcctgaatgggcgaatattgcgtaccaaccataccgataacaatagtcgtggaacacttatccgttgtggtatacaacgagggaaagaaaaggccagtttaaatacattatctgggatattacccataaatagttgggtagatttgcgtacacctgaagaatatgaaccgcaattcaatagtcatgatcttcctgaaataataaaatatctggctctccccattcgatttaaaccaccagaaaaccatctttctcatatcgtcaaacaatctgattatgtcgatctttatttcaccatgagtacggcagcatggtccattgcacaaacagtgacagaattactccatgctggcaatgttgtactccattgcagtctgggaaaagatcgtacagggcttgtagcggctgcggttctctatcaactcaaattttctaccgcagacatcgcacatgattttgctttatctgccagattcctccgtcgtcaatatcaattgattcaagataaagcacaaagaaacggtgttcccaaccatcttcaagcccgtcgttatgaattattggggcatacgattattcctctacttgataaatggagaaaaataactgaactaaacaggaatgatcatgattaatgatatgcatcgtattttaattattggctctccgggagcaggaaaatcatcttttgccaaaagattgaatgatatttgctccattcctctatttcatcttgataaagaatattggtgtgaaggatgggttgctccttcagcagaagagtggcaacagaaattgttactcttaacgaataaaccaagatggattattgatggcaattatggttccagtttgtcacaacgcttaaagaaagcagatacagtcattcatctctatatgccaacctatgtttgtttatttcaggcagtaaaacgtgttttaaagtggtatggaaagcaaagaccagatatggcttctggctgccacgaaaaagtgaatttaaatttttttcgtcaaatcctgaactatcgcaaacaccaatttaaaaaagacaaattattgttggccgattttaatggcgtctatattcgtctcacctcacgggcgcaagtagaagaatttttaaataacatggctaaatattacaaactcaatcattaaataaatatcttcatctacgtttggaatattaccactcattaattggattagaggaaaacaatcatggcgctgaatattcagggacgcctgtttttagtggcaatggccatcggtagtatgggcggtgggatctggcgacccatagcaattttttacttagtgttggttcaggagttaaacattgtagaagttggcctggcaatgacaatcggtgccataatagccctgctcattgctggtttcccagcaggcttactggctgataaattggggccatcccactcaaccctgataggaagcctactgcgatttattgcctttccttggatgatggttgtttcaacaccgtggcagatagccgttattgttatgtttgtttcaattggtgaacgtattttctggtgtgccaatccagccgcaataaggacactatttcctgctaaaaatacccaactcaatgtatttgccattataaacagttgccgaaatatcgggcttggctgcggtgcattgctatccatgttctttattggcaaggacggaatgtctaataatattgctgacttcataattttgggtaattcactcggttattttatttcaggaatgattattttcatgatcactcaaaaagcagccaagaaaattaacgaagacactcaagaagcggttcaggaagacaagatgaaaatttcatctttttcgatcattaacgataaaaaatacctggttttcgtctttttggttggcatattgctactagcaggaaaaagcattgagattgtattaccttactatttccttattgaacgcgcccttccctcttggtttgctgtttttgtttttacagggctgtgtttcggtattccctgctttcagaaggttgcattaagattaagcaataaatttggttgtctgaaatcactggcctggtcaggttttttacaaactgtggcgtatggcatcattttctttcttaatggcgatcttttattacaatttatcttaatttttatcgtgaccattctgcttagtctttctgaagccattctcggcgcgcagataggtgtagcaatattaatgttttcccgctctggttatgaagggcgttattcttccattctccaatttgcatttggcggtgcaaccgtcgttgcaccctggttattcactcaacttctcagtttttccaccaccttattatggggaagtatcatattatatgttacattggctggcatcggatttcttattctcaataaatatcaaagtgacagagccatcattctctgaattacgtgattatgatcaaaaaatcatttgattgggtatatataccattagtttatatcacggttgacaaaactaatgtaatcgagatcagaaactttgctagccagttcagcaacaatattgccaagcaatttttcctgattcagtgaacagtgaataagtgcatcgattccttcagaaggaacaccaagcacaatcatattatcattggcttcaatttctattactctttgctgtttttcatctttatctaatatgataatatcttggcctgaataatttcgtaccataccacgtaatgtcatttctactcgaacggagtcgatattcataataaaagggctattttcctgaaccgcccggttaaatagataacaaggaaacataggggctgcacgacgtaaccccaatccagaagcatggcgcggattaatttctgtcgcaaaaaaatcgctgcctgtccatatcccatcaaggctgaaaataccgcgatagccgacttcttctgcaagtttctgccctgctagacgcgtacagtgacgcatgacatcctctgcttttcctgattgccagcgattagatgatccacaaaacagcagatggttggtcgttttttcaaagacggtcagtatttctatcggatcaaaaacagcaacaccatttggcagtaccatcgcaagaatactgcacggaattccttgtataaattcagctacccgaagttttctggttttatcgcggaatttatccaaaacatgggcaatctcatgatgatccttgatccaagccaaaccatttgcccctgcgctaaatgactccgagccatcaatggccaatattacgccttttcctttattgagaaggtgaaatgccgccactgcatcattaatattaggatcgatgatctgataagcaggtgtattaattccccaccgacgaaggctgtcatcaatatagattttatcttcaaattgcgcccattcgggtttctgccaaccataaacaggtcggtctgcaaattgagaaagcggtaatctgacaccccctaaaaaagtgatatttctttctggatctattttatccaaccaatgttttatactcatacattggttttccaaaatctctttcagggggcgttgattaatattcacaatatgccagcacaatacccctttggggcgccaagactcatctgatacagatattattgcctttattttggcgccacatgtttgtaattcaaacatcagggctttcagtgtatccagattatctgagtaatcgataagaaaaccaacctcacggttctgccaatattcctttagagccttggtaatttcagtgaaccaattatctgatatcagttgcttagtcatttcattcccatccataaagtgtgaaaaattgcacttgtatcatagtaattatggtggttagctaccatcataagaaacaaggtgagcctcagattgcacatttaagcgagactttgttaataagcgaaggccccttgtttcaccttccacgccagcaccaatattgaacggtaaccaagagcaacaactctgtatatacaagtgaaattggcgtgatggcatcaaataagaggagggttattatgcattatgtcggaatagatgtcagcaagaataaactggatatttgcttgttatatgatggagttaaaggtaaacgcaaaacaaaatcccttctgaataatgaacattcagcctgtatgttaatagcgtggttagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctgctaaaatccgtgctaagttgtttatgtctgcactcactgcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttgaccatcaagacggtagcttattaggcgaatccagcccctttatcttttgctttaccgacttaattccagatcacatttgttttccaccacacatcaacctcggtaatcactttagccggatcacaatcaactggctgcaaagcaaacgccttggcgatgtgatcagatatggagtgaggtgattgataacgctggccggaacacgccataagctgatagccattgatgccgtcaacagggcagctttcaggagcatagccaaaaatcgcctctttgggaggaaaccaagcaaatcccgccatagcgtgaggataaacatctcgataggtttcctgtgagcacaatcccgcttggcccagcaaagtttctttatacaaattcaagccaaatgccatttcatagacaggcacatgccctgctcctcctgggcgacatgcaatttcacacaaaacaagacgctgtgtcttttcacaaaagaaggcttcagcatgaaatgccgtagtatcaggtgtaggcggaagagccatgataactcgtgacaccagagtggataactgcgctgtcagaggatcatccgctaataacatccaactcagcagcgtggaattcccactgacggccgaaaaattggcagtcgtacgcgaaggccagcagtgaagcatcatgccatttctcattaacccgtcaatggtgaaaaattctccttcaatccattcttcaacaaggtaaccttgtttcaattgctcgaaatcgatgtgctgtaactgcccgatatggtgaatgatctgaacaccaaccgatccacccccctctacaggtttaatcacgataggaaaaccgtatttatgggcaaactcctcaacccactgccgatcaacgacttgctgcattctagcaaccggtatcccatgtttttggagccgagatttcatgatccatttgttacggtaagagagtgccgagacttcatcctgcccaattaaacccatttttcggcgcacctgcgctgcgcgtaatacgtcaatttctgttgcggaaacaatgcgttcaatatgcttttcttcgactaccttcataatcaattcatttacagcaggtgaatcgtaattatcaacagaataaatttccttgaaatattgatgccccctatcagatgaatttgccgatgtcggcatcaatactttcggtgttacaagaaaaacctcggcatttgtctgggcaaaccataatgcgattttttctacaatagggcgacgattgagaacaagtactctcataatatttccctgccgtaatttgatgatataaaaaatattcttcctatggctgcttgggtaaacaagccaaacgaatacggagaaaagcgatattaaaaccagatacagcgataacccgaatactgtgcaaatcacatccctgattttcatccaatttaatatcaaatattacgacatcgtcatgccgtaactccgttgtttttatttcagaagcaaaacattgccccgtggatttatcatatccacgcagttcgagatgtattcgatgagagaccggattgtcagaatgaggaacatagagccgtattttagccgccaccttctctccttgccgggcgctcaagatttccgtcagattctccaggtaaatgcctccgtgacgatgagcggaaagcgggccacacacccgacatagataagtttcactgcttcccgtcgttgcctctgaattaccgaataaagaaatttctatcggtgtcccacaccgctggcatggttcggctgttctcaccacattgagcagttgatcataatgaagcaaatcaaaagcatcaaaactttcacggccttcatgcaataaagaaactagtattttttcccactggctaattaagatttggataagtgcattatttcgcaagagttgtttataatcatctggattataagaaacttcttgttttttcagggtaaatagtgccatccgttcaatatttgtcagcttctcgcgcaggctggataacttgtcaaccacagtgcggcctaaccacgcatcaatggatcgcagcaaacgatgcccatgaatgccttcttccaatacagccttaatccatccaatagctccgcaggttgtttctgtttccacacggtcacatttatctgccggttgatgctggcttacatcttgtaacgccaactgtaaagccggatcaccaagaagcacaaaggtaaaaggctgtcctaatgcagcacaagcgtcattaagtgcagccgcgatttgcccaagcggtactttttcttgtgccatctgtctaaatagcgtcaaaagataatcaggagcgatcaatgggcggataggtgccaaaacagcggctgaccatccttctgtcaatgccagtgtcattgatactggggagggataaagttcctctgcaatattgaagccattacaacaaatatagttaatgacataagcccgaatatccagaccataaaatacgtgtgtttttccatgagcacgtttacaccgccgcgccattcttgagcatccacacgaaggcatcagaggaaattctgtttcttccagcagcccacaaacggtcagtgaaggcaattttgcatgactcccttcaccatggcttctgattgttttcagcattgatggctgggaaagcaaaagaatgagttgctcaagatcgttttcatcatttgtatatttgtgttttggggcatcgatcaagcattcacgctgttctgaaagtgaaggttgaagcaatgatttagccactaaatagctaaggctggatagatctcttccacacagaaaacctatgttttttccagcctgagcgaccgtttccaatatgctggcaaccaaacctactttcagttcatacgccattgctatgataagaatatctttttcgctaatctcctgtatcagcaattttatgttatgaatgtcgttaactgggataacacgatagcccatgacttttgtatataataaggccatagagtccgtattttcgccaatgttcaatattgcgacatccttgttgtggcttatgcgaaattcctctgcatacatttcagccatcacctgatgccagcgcgcttcttgcgagggtttttctggccttataattgggattcctgagccagaagctaccgcatcatcatattcagaaagtgtattcagccaatttatcatgtgactattccaaactgattaaagtcgttgttagcccaacgaccatactggtaatttttatcagacaaccggcttatcccagaaccatacttgtaagacctttctcactaactgcatttctttgggaattgatgtgacagcatgccaagctgaatctgttctgcgaataatcgctgaggtgttctttttcggagcaatttcaacaacaacatcttttggatcagcagagcgtagcaattgcagacatccgcccatttctggaacccaatcgtccgtcagatacatcaaatgggtaactattttatggggtttatccacatgaggttgaaagaaagaaccagagccaaactcccaaaaatgtgcttgaaactgtaatttactaacatcatattcgctgacatcactgatgcattcacgataatcatctgacagaagatcccccgccaccaccaaccagatatctgccagttcatcgggtgcgtaaggctctgtttcacctaattccaaaagaggacgggtttttacgttatgttgataccattcatctgatcctgtcttgccaagagcctctgcgagtttgcgctgtgaatggtaagtccagtggcttaccggaaacatatcagccgagatcgttttctgaaatgtgttatcacacattgcccacggtgaaggatcatggttgagtttcattctctttaaagcgtttagattaagcacttcagccatttaatagacctccaataaataatgaattaatttttggtacacctttaacccagctctgggcgtcgcccaaggagataatcaatcgtttcttgctgaatcaatgatggattaagatcaatcagggaaagtagctgattggaattactgatcccaaccagaacggaaactagatcttcgcttgccagtatcacttccagtgccaatacggacgggggacgatttaattgttttgcagcatgcatcagtcggccgattgcattttttgtccgaatattgcgataaccaagacctttataaccagacaatggatgcgtacagggaacatccagcacagtacgataatgtcctcccagcagcccacgggccaaaggaagtgaggccaacaagccaagctgaaattccttaagagaaggctttatttcttcataatctgggtagttcagtatattcaagggattttgtacgctagtcagtaaagcgcctcccattgtctgtgcggtacagcagtaatgtttgatttctgatgacttcacattgcaaataccgtaacttcgaatttttccttcttttacccatgcttgaagagttgagatagtttcttcgataggagttgataaatccggtgcatgtaactgatataaatcgatataatctgtattcaaccgcttcaggctgttgttcagggattgtgtcattacggtctggcttgccccccttgccgtttcatcatgaccaaattttgttgcgataacaacatcatgccgatacccatataacgccctacccagcgctatttcactttcaccttttccgtaaacgtctgctgtatcaaagaaattcacaccaatatccaacgccgtggaaacaatatgcatgacttcttttctactgactcccaaaccaaaatgactgctcccgacagccaatcgggatacccacaagccagaggttttcaggaaacgtgaactatagtcgatcattaccaactaaccctcatttgctggacatgtctatcagccaatccttcattgatcagggcatctatatttccttcagaaagcgctcgatattgtgcaggtgtcagttgatattcttgcattacttgctcagggacatcttcccagcgagcttgcacttcaggtttagaaactaaatcatccagaagatcattcacatctttctttgtatttttcataaatcaactctcattctcgttaatataaaattttttcaatatccaattttcacttcccatttatgccagataaataggtaatatttttcattaatgatatttattgaattaaaattaattagaaacgaatcaagtcaataataatattatttattacttacttacttacttacttacttacttaacatgaatcatgtaaaatatattttcaattaacaatgacgtttaatttcaacaaaagcaattagatttttttgatggtcattaactaagagtttaataggcaagataggtgttatagccagtagatttcaaattgcagcgtgacggcaagtgaggaaatcctcaggagcatagataactctatgattggtgtgaatgaacgcaaccaacaaagcagcaacttgatctgcgaaaaaccgcctttcttgacgatttttcgtttagggtaaaaatatgtcaacaaacaatctgttattgattaatagaataataagctgattcaagggagtctatatcatcccctttcaaataaggaagtaatttttccaccatctcttcatccagatcatagattttcaacgccaacaatctcgatataacagagggttcaaaacgatatttaatgaatcgggcaggatttccacccactacggtatacggagaaacatctttcgtgacaatactccccgcagcaacaaccgctccctctccaatcgtgacgccaggcatgatcattgaacgcataccaatccaacacccatcagacaaaatcgtatcaccggaatgttggtaggattctttaataccttccaaaaaaggatagacagaaaaccagtccattctatgagtatgattgcctcccatcagaatgacagcttctgatgcgatacagacataatttcctatgtaaagcttatcaacgacacctaaaggttcccacccaagactgatttcatcaccataaagataacgaacaacactcttctcaaaactatcactccaacagtgactataataactgtgcgtgcctttaatctttatattggggttggttactgttgaatgtaaatactcaacttgtgaccaatgtttttggtttccactcataaataattatccaaaaaaatagtaaaaggatagctcagtttatccactttaagagaaatttctcttaaagtcatattcatgctgaattttaccagattatattatgatagagatttataatatttattccccatgattgaacaacctactgacataactccacaggaacgatcaccatctccgtaggagatggttttagaatgacaataaatacgtcaatttttccaaagcaatatggctgtttgttttacccgaataagcacaaacaaaatataacaatgtcagcacaacagtcataaattatgacaataatccctgactttgaaatatacgctggtaaatctcacgtacaacctgttcttttctctgattatagtgcattacctgactgacattatctttggcgtttatcttcgcagtcatatatcgttggcaatcttcaggatgttctctgagccaatcgcgaaacaaaatatggcgaatgtgttcagggcaatctggaccaaaaacatgaaggttgactcgtggttttgctaaccgtaggcagcgatgttgataaaaactcggttcacgcaccgttaagtcataaccaagctgctccagcgccggaacataagtttgttcctgaattggatctagcacaatcagatcgatatcaataaccggcttggctgcaagaccaggaactgcggttgaaccaacgtgctcaatatgcaagacaatgtttcccagtgctttcttgatagacgcagagagttgctgccatgtaactacccattcaggattatatgccacaacacctatcacctcttcagcaggtttaccatgcacccaaggattttcattaggatctggctctggaaaaaagataatgtctttaggatttatcattaattcactccttatttttctatctatacccaatggattaaaagagatcatatccaatatgacctctttgcacgatagaaacatcacccaacgccagaattactcttccaagatgggttgaggctgttcaatggcgggagcatcctgtccaaaaccacgcagaccaatgacatgcacatgttcatgattattaaatattttacgtactaatttatacgttgtacctttttctggactgatgttttccggcgctgcgataattaactgcatctgcaaacgttcgcacagttcaaacagcgtggcgattgatttcgcatccaaacgcgccgcttcatcaaggaacaacagacggcatggtgatatgtctttaccacgcagacgccgtgattcctcttcccaactctgcacgaccataaccagaattgacatccctgtaccaatggcttcacccgtagacaatgctccactttcagctttgagccaaccatcagagccacggttgacttcaacgtccaattcgaggtagttacggtaatccagtaattcttcaccaatggtctgcggtaaacgctgccccatgtcaatttgtgggttcagacgctggtaaagtttcgccatcgcttccgagaaagtcagacgctggctcttgaacagatcctgatgttgctcctgctgttcggaaagcacatccagcaagattgaatggctttcacgtacattgacgttcaaacgcactcctcctacctgaccaaaagaaacagcctgcaatccctgattcaacattcgaatacggttctgctcgcgctgaatcgtcttacgaatgatattggccacactcttggaactgatcgccagtttttgttcacgcgccgtcaattcttccgtcaaacgagccagttcaatttccatctgttcaatggcatcaaccggatcatcggtacggataatatcttggcggatacgctcacgcagatgttgataaacagcaacgaaaaattgaattttacgttctggacgtttgggatcttcagacaaacgcagtgcatcacgcaggtgttcattatctgccaccgccagacgcaatgcccccagcgctttatccgacattgaacgcagttcatctccattcatataggccagttcgcggcgatggaggcgacgctcgacaccattatctttcaccatccgcataacagcacaccagccggcttttgaagaaaccacctgctcgcgtttctgataatagtcacgctcagatttacgcaatttcttctggaggttttccatttcggcctcacaaaatgcgatctgtttctcaagctggttgatgcgggaacgattggtgctcaaggcagtgtgaagctgatcgcgacgttcacgggcacgactttctgcattcggatcggcctgaacaccgatgtctttcatctcctgctcaagttccttcaacatatcctgcttagtgtcataggaactcttcaatgaggccaatacttgattaaattgggcgtattgtgattgctgctggcgcaattgttcacgggcacggctgcgatcagactccgcatgttcaaggcgctggcgcaatttatcattcagatcagcattgtcactgagcattcctaccgaatcgctatagctgaaatgtgcacgacgctgcaccacttccgtcaaagcaaaagcttgctgtttcgctttattctgggtgtgcttcgccgtctcataatcctgctttaactgctcatgctgctgtggatcgctttgcaggacagaaaccagcggttcgagtttgttcagtgcatgactatgctgttgcaaaaaacgagccgcatcttgtgcttcactcatttcttcacgcaccgtttccacacggtcgatcagcgtttcatccagcaagagggtaatttgtgggatcaggcggttcagcgctgacagactctcttttacctgagccagtttctggtgatgctgttgagtctgtgcttcaaattgagagagttcgcgctccagttcaattcgctgctgattcaagctacgaatatcagcttctggatcgtcatcaaatgcaactgacagatgtttgcccacaaaacggctgaaagcctgataggcgcgctggattttctggacgtcaaacgaaagcgttgcatagcgttctgccagcgtatcacgttcaaggttcagtatttccagacgattttcccttgcagcccttccaaacagcggaacgtcaggataacgggaataacgccactgacgatccgatgatttcaccagaacagcatttttccgctcttcgaaatccaagacgctatcatcgaaggattgcggatcaccttcgatcagatagagatcttccgggcaatcttccagtgcttccagatgtggacttaccaacgaaagatccggcacaactatggcatgacgggctggcccgtacaatgcggagaaataaggcgcatcatcaatggtgatgtcatcataaatttctgacagcaaaataccaccaaaacgttccgctaatgcaagcaatctgctgtcttcggcaccacttggctggctcaaacgctcaatatgcttttcaagctcacgtttctgtgctgctacatcgtcacgttcgacggtagtttcgcgttcttgctccagcaattgttgcatgtattcagtgacatcattggcactttcgaacgtttcgtcgctctgttcacaaagttggttcaatgcatcctgtgccgtcagccaaactggtgcacgtgttgtcaatccctgaattttctgcttaagttgttccagttgctgacgcatctgcatacggcgctcgccgctttcactggcattcaggcttaactcttccaactgggcttccaattctccctgcaacgcttctaaatcttccggctgatattgctggttgtggcgcttgcagaattcccccagtaagcgctctgcattttgctggctgttcaggcgctgttccaattcagctaattgaatacgcagaggctgaacacgatccgtcagatggcgttgggatggccattcgcgcagtacttcacgggcactttgccatgctccgctacggctcacctcaccaacaatatttttcaccagttgataagcctgctcaaactgactatgggcagcatctgccacactcagcttctgctccagcgccagcaaggtttcagtcgcttgttgttctttggcctgataagtttcctgccactcatcagcattctctatcaataaatcagggagctgacaaagctcacgggcacgttccagtgcttgcagcgcctgttgatattggatcgagcgagtttgttgaacatccaacgcctgctggtaatcagcaagctggctttttaattcatcaacttcctgttcagccgcctcagacacagtgtcatattctgcctgtaactctttcgcttcttcgacaacttcagtctgttcttccaggcgataagtcagctcttcaatatctccttgataacgatctattttctcctgctgacgcatggccgtctgaactaaattcagatgatcactagccgcctgataatccatctccaaatcagaagatgcaccactctgttccgtaagctcccgtgctatttcaacatggcgatactgttcagccactaattgacggcggctaccaaacaattcactgcgcaaggccaaggcttcatccagatggatacggcgctcattggtatgacgcatgtagtcagcagaaacataagctgtcgcttccgtgatgagatgtttaaacagatcgcgatcagattgggtaacgcggattgcttccagcgtgatgcggttttcacgcagtgccgcttccatgtcctgaaacgcttttctaacgccactgttttctggcagtaagtaatcgcgcagtgagcgagtgatggcgctggaaataccaccatatagcgatgcttctatcaaacggtaaaacttactacggtcactggccgaacgcagacgttttggaatcacccccaaatcaaacatcagggaatggtaatcagtgatagagttaaattgtttgaactgaacaccttccatctcatcaaggcgctctttcagctcatttaatggcagaacccgcgcctgacgttcgccaatattttcggtcaataactgcgttggctgtaccgatgcagggacaccctggatcatgaagggtttgatatcaaccttgcggtcacgcccggcaacctgctgtaagcgaacccccgcaatgatccgctggtggcgggagttaacgacatccagcgtggaataacagaccccggcacgcagtttaccgtgcaagcctttatcacgggagccactggttgcgccagcttccgtggtgtttcggaaatgaagcagcgtcaagtcagggatcaacgctgtcacaaacgctgccatcgtggtggatttacctgcaccattaccaccggataaggtggtcacgagttcgtcaagatcaaacgttctagcaaaaaaaccgttccagttaactagcgtcagtgagcgaaatttaccgcgttcaatcatgactgtttatcctccgcaccttctgctgaatgctctgatacttcttcgtgttcattatcttcctgcaataaattgccttccaccggcatcgcttcaccatcacggatcattcgtaattgtgcttcgcgtgggtcgtcaccactgcgtacatctgcaccaaagcggaataccgtttcagtaatcgtaaatttattgctgtcattttgcaggaaataggccattcccaaacggcgcagacggtttagggaagtccgtgctttttcctgtagtttttgtttatccagatcggagcctgtggaacgttggttcaccaatttcatcagtttactttcgtcagcgagcgacaacagctcgtcatacagttcctgaaaggtaaatattccctgattggacaggcgttctgggctgagatagaggtagcacaggattttacctaccatcatgtccatttcagacagaacagatcgagggatcagcgtcgttgaacgcggacgcaggtagaaaaaaccttctggtgcacggattaactcgacattatagcgagcataaaacgtttccagttcctcctgaaaatccatcaggaaagcatgattatcaagatcatccatcccaatatgacgccctgaacgaagttggctgtctaattcaggaaaaagtgtgttggataatgcctgagccagtttgactggcataaattgttcaatatgtgtcgatgacatgtgcctgcaccttggctccgtaatcattaatcgctaaccattccgctggcaacccagagaaatccgcttctgcaacgcccagccgtactgcctgatccaccagaatacgcgccacatcgaaatggcggttacgtggatattgagcaagataatcgcgcagtactgcccccaaatctaatgggagcctggcctgttggtagactgccagtgctcgtgccaccatctcggccaactgttcgttgatttcactaaattcttcatattccatgtctggcggtaattctcccattacctcttcattgcgcaatgtcagttcttcgtcgcgcatatccagcaaacgctctgcattggcgatggtcagcgcccacggatgatcaaaatagtgttggatagattggcggagacgttgagcaaatatgcggttcttatccatatcgatagcggtacggataaatttgtgaacatggcgatcatagccaatccagagatcgatagcctgttgcccccaactaataatgcggtcgagtttactttgcagatcaaaaaccagtttatccaccaattctaagccaccgctgcccatattagcatcctgaatacgcagtagattggcctgtaatttatcaccagcagcttctagcgtatcctggagctctctcaatgtgcccgacgtttcagacagtaaatgctcgcaattagcgatagcagcctgccaatcttggttgaggagtgcagcaatgtctgtttttacgctgttttgctgttcatccatagtacgctgtgacatatcgatgctgtcaaaaatttcagcgacagaatatttgagcggcgcaaaaacattacggtgccaatggaactcatcgccgccttcttcagcagattcagccgcccgatgcagttcgttggcaacaatggataactgcatggaaaggcgcaacgtggaaaattcgcgctggcgaatataatagtcactgataccaatacccaatggcgtcaaccgatagatagcattgccatccgctaattcactggtaaagcggttaatcagcttttggcgtaccatatcgttaatggcattattcgcccggacagcaaccgcctctgacgtttgttcaaaacctttgcaaacttcacggaacgcatcaaccaactctccctcgctcatttcgccatcaaaacgttcgctgttcagcactgagattgccatcaaaaaagccaagcgttccggtggcaacgaaatcgaaaaatcattctttctggcccaggacacaagttcaggaacagtctgggaatattcactcataattcactctttaaagtcgtcttgcgtgccatcacatgaatgtaacgccccaggctgatatagggctcctgtctgcaataacgttgttcaagttcaagcaacgccggaaaatctgtattttgtaattggcggctttgcaggtagtcgtgaaaaaccctaacgcctgttttgcctgttatttccatattgagttcaataagccactgatatacctgttcgggtactaatggattctgtggcgataaagaacgctttcggcgacgctgaatatttggcgttgccaaatgaaagttacccaatatggcattacgcatgaccagtccattagcattataaaacattaatgaaagtgctccaccgggtgttattatctcccccaatgtttctatcgcatctttttggtcagtgatccattccaatacggcatgaaatagaattaaatcgacgggttgtttaatgtgttgaccaatatcctgtaccgggctttggataaattgcatctgatggagaacaccccgctcctgtgcattacatttcgcccgcaggatcatttcttcagagaggtcacataatatgacctgatggcctaattcagccaattggcaagccatgtttccttcaccgcctcccgcatccaaaatgcgcagagggcgctgaggtaaatgattcagcaattcgttgatatcctgccagacaacggcctgcctgattttacccttggttgtgccgtaaatattacgtgaaaatttgtctgcaatatcatcgaaattgcgatcccgcatgaaaaactgcctcactgataagctaagtttaatttatttattgagtaataatgctggctactgttattttggcacagtactcattgaattcactacttttagccctaaattcgaccctgggcggctataattccaccaaaccaaggccaatcaatgttatttctgcttaaaaaatatgttggcgcgctattaatgcctttgcctttgattattcttgtttctttgacagccctgctatttctgtggttcacccgctggcaaaaaacgggtaaagccatactgtcactgagttggcttgcgctacttttatttagtttacagccgattgctgacaaacttttacttcctatcgaagggaagtatgttcaacgctatgagcctgacaaagcatatactgcccccgtaaaatacattgttgttctcggtggcggtttcacttacaactcacaatgggcgcccagtgccaaccttatcagtaatagtctgcccagagtcaccgaaggtattcggttatatcaccttaatcctggtactaaaatgattttcacgggtggtagaggcgttaattcaatcagtagtgccgaaatcgctgctatagtagcacaatctttgggaattcctgtagaagacacgattgcattaagagaacctttagatacggaagaagaagctgctgaagttgaaaaagtgcttgggcaacaaccttttattctggtcacttccgccaatcatatggaacggtcgctcaagttcttcgaacggcgtggtatgcaccctatcgcaggccctgccaatcaactggctgtgacaactccactatatgcatgggaaaaatacattccatccgcctattatttttcacatacggaacgagcttggtatgaaacgctgggtaaaatttggcaggcaataaagccagtaaataaagaggcagcaaccgagaaatcagagaactcttaatagaaaacagtgagagccaaaatcatactgaaaaaagagaatgccgcttccgcggcattctcttttgactgttataccggataacgtgttcaacactcagcaaaagcttttctgacggcttccaaatcttcaggtgtatctacccctgcacctggcgcttgtagcgctttcgcgacatgaattttctcaccgtaccaaagcacccgcagttgttcgagcatctcaatgctttccaatgggcttggcgcccattgcacgtagcgacggataaatcctgcccgatatgcataaagcccgatatggcgcaagaagttatccccgactgtttcttttgactgcataaagcgatcacgttcccacggaatcgtggcgcgtgagaaatagagcgcatagccctgcgcatccatcacaacttttacagcgttagggttgaatgcttcttctgcatcttggatctgcactgcaagtgttgccattccagcatcactttctgccagattatcggcgacctgcttaataatttgttctgggataagtggctcatcaccttgaacattcacgatgatctcgtcatcagcaaattggtattgatcaatgacttcagctaaacgctctgtacctgaatggtgatgcgcacttgtcatgcaagcttcaccgcctgcagcagtgactgcatcaaaaacggcttggttatctgtcgccacaatcacccgattggcaccggagcggatagcccgttccataacgcgcacaatcattggcttgccatgaatatcagccagcggttttccaggcaggcgagttgaagcaaaacgcgctggaatgataacggtaaacatgaattatttttcttcctctgctggcagggcgcgggcttcattttctaacagcacaggaatgccatcacggacgggaaaagcgaggtggtcaagtttgcaaatcagttcaaagttttctttatcgtaattaagcttaccgtgacataccggacaagcaatgatttcgagtaaacggtgatccatatatcccccaaatgacgggcttcgaatttaatgcggttcagaataccacaagcaatgtatcaccgttaactctgttattttgttgaatgttgtaatgatttaccaagattatctacgcatgttcactttagggagtaaagcacaaatttcatccagcattttttgctctttttcttctggaaaatgtgcagaaaccggtaaataccaccaattaggctgcgcgaattcgaaacatttaactgcatctttttctgtcatcagcaaattctgcccatcatcggtcaaagccgacaattgagttttatcataagattgatgatcagcaaaagcgtatgtttcctgcaaaacagctcccaactgctgcaaagttgcaaaaaaacgcggtggatgaccaatacctgccattgccaccccattgggaatatcactgacctgacgcgattctcctgtcagcaggttaatcgccagttcaccttttagcgtcatgggcaattcgcctgcttccggtgttcctccattaacaataatggtattgaccgtatttagacgaccagcgagttcccgcatcggccctgccggtaaccagcaaccattaccgaagcgacggataccatcaatgaccacaatttcataatcacgctgtaaggcataatgttggaggccatcatcggtgatgatgatatcaacgggaaaatgcgttaataacgccttgatagcatcggtgcgtttcggtgcgaccgcaacaggtgcaccagtacggcgatgaatcaaaactggctcatctcccgcttgtgccgttgtcacttcgcctgttaccaacagtgggtaatgttccgctttcccgccataaccgcgagaaacaacaccaacctgatagcctgttcgctgcaattgttcaaccagccaaatgacgactggtgttttgccattccctcctgccgtcaagttacccacgacaacaacaggtacaggcgctttccaagaacggatcaaccccagtttatagcctaaacgacgcagaccgcttatcagcccataaagggctgacagtggcaatagcaagatgtaaagccatgaacggccgaaccatatgcgttcaatcattgaccaaattgcatccgatgtaattgggcatatgcgccatctttttccaacagaaccgaatgattacctttttcgacgataaaaccgtcttcaacgacgataatttcatccgcattttcaatggtagaaaggcgatgggcaatgaccaaagaagtcctgtttttctgcaattcgtccagcgccgcttgtatggcgcgctcagattcagtatccagtgctgaggttgcctcatccagaataagaatcggggaatcacgcagcaacgcacgggcaatggcaatacgctgacgttgcccgcctgaaagcaggacaccattttcaccaatcatggtatcaagaccctgatccagtttcttgataaagtccatcgcataggccatttccgcggctcgttcaatttcttcacggctaaattttccttcgctggcataagcgatattattagcgaccgtatcattgaacaaatggacattctgcgataccagcgctatctggctgcgcagtgaagacaatgagtattcacgcagatcatgcccatccaatatgatgccgccttcattgatatcgtaaaaacgagtgagaagattggcaatcgtcgattttcctgaaccagaacgccccaccaatgcgacagttttacctttaggaatggtcattgagatgcttttcagcgcaggatgatctttggttggatagcagaatgtgacattacggaattcaagatcaccttttgcttttttcagctccagcttaccttcatctttttcctgctccatatccagaatcgcaaataatgtttggcaagcggccataccacgctggaattgtgcgttaacattagtcagcgatttcagtgggcgcatcagggcgatcatggatgaaaataccacggtgattttacccgcagtcagtgcgcccataatttccgggaaactggcagcatacaggacaaacgctaaagcaaaagaagcaattaactgaataatagggtcagaaatagacgacgccgacaccattttcatgccttgctgacgcatatggttactgactttgttaaaacgtttagtctcaatcttctgaccaccaaagatcaaaacttctttgtgccctttcagcatctgttctgcgctggttgtcaccattcccatgctgttctgcatatttttgctgatattacgaaaacgtaccgaaacaagacgaataacaagagcgacaatcggagcaatgacaatcaagatcagggaaagctcccaactgtaataaaacatcagaatgaacaggccaataattgatgctccttccctgacaactgtcaccagcgcgccggaagaagaagaagcaacctgttctgaatcgtatgtaatgcgggaaagcaatgtccccgtagattgctggtcaaaaaaggaaactggcattcccatcatatgggtgaacagacgacggcgcatctgcatgacaactttgccagatacccaagatatacaataacttgatataaaacccgatatgccacgcaaaagcatcaacccgataacaaccagtggcatccactccaatacactcatgtctgccttgccaaaaccctcatcaagtaaaggtttcagcaaagaaagcatcaatgtatcaccggcagcatttataaccagtgcaatcgccgccactgccaaccctagcttaaatggtgtgatgagcggccacaatcggcggaaggtctgccaggtagaaaggtctttatcattcattattgagttaccaaaaccaaaagaaatagcgggtcattctactcatgatcgctatgaataccaaaccactgatgataccaccgtgacattatgtgttgtctataacctgctaatttaatgtgatcacgataaaaacaaccggtaatctggccggaaaccgaagtactatgccattgaatttcagcatttttataacgtttctgcactttcactgaaggcaacttccacgggctataacgggcaaccgaagttaatgcatatttaggcataactgtccgtataaataccgctgtggacgaagtattgctcccatgatgaggaacttgcaatattgttgcattcagatgttctcgctcaagactgactaagcggtattcactctgtttttccaaatcacctgttaataatagactgtgtttaccatcatcaatgcggatcacgcaagattgattgttaccgacaaccgctgttttttcttgcggccagatgacccgaaacgttaattcctgccaggtccattgctcaccacgaatacaaggcaaatgtgattgctcgatcaaagaactcctgatttgaatatcaggatatttttcgcgcaaatattctacgccacctgtatggtccaaatgatcgtggctgagaataatctgttctggtgtcaaacgatgccaacgcaaataaggtgcaatgactttttctgccatacttcccgtttcccaacggtttcctgtatcaaaaatgattgcctttcctcccttgtcaatgaccactgccaaaccatgtccaacatccagcatcgaaaaacgccattggtattcatcatcgcgttttaaataacagacaataattccaatcgagacacctaacagccatttataagacttccaccagcccaaacgccaaaaaatgacaaaaaaccaccccacaagcgttataaagatagggaaataccctgtttcaaaccatgaatgtgttaaaatctgcaaaggtgccaaagcgagtacaatactgtaatcaaccaactgccacaaaattggctgaataacaggaagaaagaaacaggataacgctaacatcaccagtggcacagacaagaaagagactatcggtacagcccataagttagcaaccaatgatgcaatattcagcccctgaaacagcaaaagctgcaacggcaacaacattagcatcattcccaattgcatatgcagcccacgtagccaactccactgccagccataacgaataccctcgggtaagggcatccagtgaaaccagaataacaacgccatcaccgcagtaaatgagagccaaaagctgtcagaaaggattgccagtggatcaaacagtaaaatcagggctgcactccataaagcccactgccatgaaaaacaaaaccggtttctgcatcgcagataaatccaaagtgttaatcctaatattgcccgaacagccggaattccccagcctgacagccaagcatataacgccgcagtcagccaccccatgaggagcgggaaacgaaaactcacccaccttgccggaaagagaaactgaatgcccctggcaaggctccagccgaataaactggccattgcaatatgcaaccctgaaatcgccataagatgagcgatgcccgtttgctgcaacagcagtctggtttgttgatccagccactttctttcaccaaaggtaagagccagagcgatacctgcatatttcaatggttggatttctggcgccagtttatttatcagatcttgcctaaaactgcactgaccattcagtaacctcgccttagttattttgccattaagtggctgacgaatagaaagtgcatatctctggctatcatagcttccatggttcaattgagcatgaaccggcctgagtttcattgtgacctgccatatctggccagcacacagcgattcaggagaattccatagtaccgatgcaaataaagcagggaaaatatattttccatcactttcaattaatcggatccgataacgttctttttctccctcattatttttctcagcacctaaagatacgctctcaatcatgaccgttgcagaacgggaggtttcgctgaaataagtgatttgattcaatatcaggtgaccatgccaacatccaaaaataaatgtccatagcatcagcgaagttatccgagtggatttacagggaacaaaccataaacaaaatgccaacccaatcaggaaacaaatttccttctgctgaggtaattcagcaagcaataataaggggatcattcccagaataattgctatagcagcctgattcagactgataataaacagcggctttcgccaaatggagagaatacaagtaaaggggaaaaaaatgataggccacatccggttatgcctctgcgctgacattccattcagacagacaagcctattccattatttatgctgcgaccagacagataagtactaatatagaatcacttcgcaaattagttcgtcggtcaagaaaagacgacaaaataatgcgaaaataatcacaaaaaaacggcaccctaaggtgccgttagcaattaagtaataacttctatcttagctgtcgctatagatattcacgcgatcgcgtaactctttacctggtttaaagtgaggaacgtacttaccttccaattcaactttatcgccagttttggggttacgacccacacgcggagcccggtagtgaagagaaaagctgccgaatccacgaacttcaattcgttcacctgcggccaatgtttctgccatatgatcaagcatttctttcactgcatcttcaacggctttagcgggcatgtgagattgttgctcagtaagtctttcgattaattcagacttggtcataatacctccctaaactaccgtatcgggtaataccgccgtttccgaggtatcacccaatgttattgacttagattattcgcctttagctgctttgaaagcttcagccattgcgttgttagcaaagctcgtatcttcttgtttgttcacagaagcgatagcgtctttttcatcagcttcgtctttcgcacgaacagacaggttgactatgcgatttttgcgatcaacaccaacatatttagcttcaacttcatcgccaacgttcagaacttgagttgcatcttcaatgcggtcacgagaagcttctgatgcacgcaggtaaccttcaacgccgtcagctaattcaactgtagcaccttttgcgtcaactgcagtcactttaccattaacaatcgtacctttcttatttacagacaggtaattgttgaatggatcttctgccagttgcttgatgcccagagagatacgctcacgctctgcatcaacctgcagaactacagcagcaatttcgtcgcctttcttgtattcacgaactgcttcttcgcctgcaacgttccaggagatgtcagacaggtgaaccaggccgtcgatgccgccgtccagaccgatgaagataccgaagtcagtgattgacttgattttaccttcaacgcggtcgtttttgttgtgagtctcagcaaattgctgccaagggttagatttacactgtttcagacccagggagatacgacgacgttcttcatcgatatccagaaccataacttccacaacgtcaccaacgttaacaactttggatgggtggatgtttttgttggtccaatccatttctgaaacgtgtaccagaccttcaacgccctcttcgatttcaacgaagcagccgtaatcagtcaggttagttacgcgaccagtcagtctagtactttctgggtaacgtttagcgattgctacccatggatcttcacccagttgtttcagacccagagacacgcgagtacgctcacggtcgaatttcagtactttaactgtgatttcatcgcccacattgacgatttcgcttgggtgtttaacacgtttccaagccatatcagtaatgtgcagcaggccatcaacgccgcccagatcaacgaatgcaccgtagtcagtcaggttcttaacgatacctttaacttccatgccttcttgcagattttccagcagttgatcacgctctgcactgttttcagattcgataacggcacgacgggaaacaactacgttgttgcgtttctgatccagcttgatgactttgaactcaagctctttgccttcaaggtgagcagtatcacgaactgggcgaacgtcaaccagtgaacctggcaggaatgcacggataccgttcagttctacagtgaagccacctttgactttaccgttgataacaccggtaacagtttcggcttcttcgtatgctttttccagcatcagccatgcttcgtgacgttttgctttttcacgggacaggatagtttcaccgaaaccatcttctaccgcatccagagcaacgtcgatttcatcgccaacttggatttccagctcgccctgagcatttttgaattgttctacaggaattgcagattctgatttcagacctgcatcaaccaatacaacgtctttatcgatagaaacgacgacaccacgaacaatggcacctggacgagtttcgataacctgtagggattcttcaaagagttgagcaaaagattctgtcatgttaatgatcttcaaggttttaaattaacgtccatctagcatccagccgaatggggttgttttacatacctcgcaactattccctgttacaaggtgctttggtatgccagcatattttactgcccacataccaggattctatatacatcttcttggtgcgctgttgcaagagtacaacatgcgaaaacaacaattacgcaggcagtgccagcgcgtttttcgcataagtcagggccttatcaatcacttcttcgatagacatgctggtcgaatccaagagcaatgcatcatgtgcaggcactaacggcgcaacggcccgattacggtcacggaaatcccgctcctgtatctcggacaaaaggcggtcaaagttaacactaaaacccttctcctgcaactgtaacatgcgtctgcgggcgcgttcttccgcgctggcatcgagaaaaattttcactggcgcatcaggaaataccaccgtccccatatcgcgcccatcagcgatcaaccccggtgcgatacgaaaagcccgctgccgacgaagcagtgcttcacggacacgaggaaatgttgccgcctgtgaagccgtattgccaacagcttcagtacggatttcattgctgacatcttcgccttccaggatgaccctgagtttgccatttgcaggcataaaacgaacatctagatttgcagccagaggaaccagtgagtcttcggattggatatccacctgatgatgaatggctgccagtgctaatacacgataaatggcacctgaatcaagtaattgccaacccaatgcttcagccagtgcctgacagagtgttcctttgccagcaccacttggcccatcaacggttattactgaggctatcgccaccattattttcctccttttcgcatagcgctttccgcacaacaaacgggtcatctaccgattgcagaaaattgctcaattaatgaacagtaaaatatctcttattatacgcactccgcagatgagtggaataagcacatcatgattacctgacgattttcactatgagtaagccactgaaatggattcaatccctgattacattatgtattgactcagtttttcaagctgattgaaataatctgggaatgttttggccgtacagcctggatcaaggatcgtcactggtgtatccgaaagtgcaaccagcgagaaacacatcgccattcgatgatcattataggtttcaatttcagcatgattgagcttttgtggcggaacgacacgaatgtaatcattcccttcttccacctcagccccaatcttgcgtagttcagtcgccattgcattgagacgatccgtttcctttacccgccagttataaatattgcggatgacggtttcaccttgagcaaacagcgctgttgtcgcaatagtcatagcggcatcaggaatagcattcatgtccatatcgacaccaatcaatgtaccacgttcacattccacaaaatcattaccccaacgaatcgtcgcccccatcttttccagcacatcagcaaattttgtatcgccttgcaggctattcttaccgatgcctgtcacgcgaaccgtgccaccttttatcgcagcggctgccagaaaataagaggcagatgaagcatccccttccaccagataatgtcccagcgattggtattgctgctgccctttaacatgaaaaatttgatattggtgattttctaccgtcacaccgaaactttccatcagcgccagagtaatatcaatataaggtttagaaaccagatcgccctgaatatgaatttctgtatcattcgccgccaatggtgcggccatcagcaaagctgtcagaaattggctggaaacactgccatcaacgacaactttcccccccgaaaatccacctttgatatgcagtggcggataattttcctgttcaagataatcaatttttgctccgccttgacgcaacgcatccaccaagtgaccaattgggcgctctttcatccgaggttcccctgtcagcacgacattgttgtctcccagacacagtgccgcagccaacggacgcatggccgttcctgcattgcccaaaaacagctccagcgcaccttttccggtgatagttcccccaataccatcaacttcacagcaagtacgatcgtctgatagacggtagggaatttcgagtgctgtcagagcattaagcatgtggcggatatcatcactgtccaacaaattggtcaggcgagttgttcccttggcgaaggctgcaagcagcagcgcgcggttggaaacacttttggagccgggcaggttaatagttccattgatacaggaaataggttttaacgtcagggattgcataaacagcgggatctccggtttttaatacgttgtatttgtaattttcgctttaattttttgaaataaatgaggaatattcacatcgggaggtttcattcctcccgatgataagcgcattatgcgttacggcgttcaaaatcagccataaattcagccaatacctgaacaccttcataaggcatagcgttataaatggaagcccgcgcaccaccggcaactttatgtcctttcaaagcgtgcaacccatgtgcataggcttcttccagaaatttgccatccagtgttggattggccagttggaatggtatgttcatgatggaacggttctgtggtgcaacacggttgatatacagattactgttatcaatagcgcgatagaggagttctgctttcgcaagattgcgtttgctgatttcctgtaagcctccctgctctttcagccatttgaacaccatgccagagagataccaggcaaatgttggcggagtgttgtacatagagcctgatttagcctgcacagtgtaatccagaattgatggggtatgttgatgtgctttacccaataagtcctcacggacaatcaccactgtaattcctgctggcccgatgttcttttgggctcccgcataaatcacgccgtaacgattcacatcaatcggggctgaaagaatagttgaagagtagtcagcaatcacgatcttatcatcgccaaaatcaggctcttcaaaaattgcaataccttcaatagtttcattaggacaataatgcacataggcggcatcactgctcagcgcccattcactcattggcttcacgcttctgatgccatcaacttctgtcgtaatatttatgacgtttggtgtgcaatatttttctgcttctttcgctgcacactcagaccaatagccactgacgatataatcagctgtcgttttgttaccaagtagattctgtggcaaagccgaaaactgaccacgggcaccaccatgacaaaacaaaactttataattctcaggtatcgctaataaatcccgaagatctttttctgcttcagccgcaacatccatgaactctttgctacggtggctgatttccataacagatgttcccaggccatgccagttgcaaagctcttgttctgcacggcgtaatacttctgctggcaacatggctggaccagcgctgaaattatatacctgactcattaacttcaccctatcaacggatacaataaaatcggatgtattggttttatcatccccgccctgtcgctgcaatggttattaaaagattgttgcaacctattgtataactggttgatagactgcgttattaataatatggatataaaaaaaccaataaaacagccagaatggtaccgctttcaagctatcttaaggatttaaatacatttaaataacaagataaatatataaattaagataaatagattacttttcatataagtatattgggtattaaattcacactctgtagttttcaattttcattttattttagaataattagctattatcgcgctgatatttttcctaaaatattatatatactcaataggtttcaaattgcagagcgggagcaaggttaatatcaaaaatatatatcttgattcataatctagatattaataattaattttttcgtatattttatctggttagctgtattttattgattctattttcagctatttaatgacgttccgagagatatattaaatagcccaatccagactttccgttatttatgaccacactatggagataaacaaaacattgaactgatttgtaaagtggatgaacaatcggcttcgtctcctgcatgctttctcgggttgttaattttttgttcaaatacccataaaaaataacattgacatcataaaggtaaatgcgattctctctcgaagtcactaggattaatcctaattatccaaaaaaattacaaattaggatttttcctataggtgatattatagacagagacaatctgccactaatttatcgaggacatcattatgattcaagaaattatgaatattgctcccagtagtttcgcggaaagattaacacacgtcattgataacagtgtgattgatatctttatacaaaaaaccgtggaatatcctgaaaataaagcaatcattaccgcagagcgaactgtgagctatcgtgaactggctcagcaggcacaatctctggcagtttatttacgccaacagggagtaaagtatgaatcccctgttgccattttgttggagccagggattgagcaaatcatttgtcaagtagccatcttactggctggcgggagctgcgttccactcgaccccgccatgcctgatgagaggctaggttttatgctgcaggatttgcaagtcaacctgacattgacagatatcaaatcgcaagagcgccctctgcccacaaatttcatcactatgaatgaaagtttactgaaaccgacggatgcggttcacttactcgatatccatagtggaaaaacgcatcggactcatattttattcacatcaggaacaacaggaaaacccaaagcagttgaaattgaagctcagggtatcctccatttcgttgttaatacaaattatattaatttcgtagccaccgacaaaatagcttgcattgccaaccccacatttgatgcctctttatttgaaatctggggcgcgttattaaatggggcgacaatagtcattattcccagaaaaacagttatcgatccttatctgtttgaggccacattaaaacgattttctgttaacaccatgtttattaccactaccttatttaacttagttgccagtacgtgtccttgggcattccgtggtctgcgttatcttctggtcggtggaaaagcactcaacccttattcgctgcggcaggttttacaatcctctcctccgcaacatctgataaacggttatggaccgactgaaagcaccatttttgctacaacccatgaaattaccctggatcaactaaccggagaaagtatacctattggaaaacccattaataatacggaggtttacattttggatgaccagcaacaatttgttgcaccaagccaattaggtggaatatacattggaggaactggtttagcgcggggttactggaaccgtccggaaattaacgcgcaacgttttattgtggcggatgttaataagaataatacattaaggagagcctataacacgggagatttaggctggcaacgttctgatggcgtttttatgtatgcgggacgggcagacaaccagataaaactacgcggacatcgcattgaaattgaaaagattgaagctcagttgctggaaagtcaatttttgaaatcagcggcggtatgtgtgatcaaaaaagaaaacatagaaccttatctgaccggttttattgtccctaaagatccagactcattttcaaaacaagaattaattcaatggattaatacccgcttacccaactatatgctgcctcagctggtcgttatcgggcatataccagtcacccacaatggtaaaattgatagagcgcgcttactggaggaatgtttagaaaatcaagaacaacaattattaccccaatcaagtacacaaatgagtgaagaagagtctgccatcttaaatatttggcaacaggttctggattcctatgatctgacactagatagtgatttcttccagtccgggggcagctcgttgcaggccgccagactcgtcgttgaaatcagacgcaaaatgcagcgcagtttatcagtccagaatttatacgatgcccctacaccgagaaaactcgtggaaagtctccaacaaaatcatcaggaagacattgatatatgcactgttatgctcaaggacggtgtgctgccattagatattcagcccttgtctcaacccctccagccctggcttaccccaaacacggggcgagtattattaaccggagccaccgggtttctgggcgcttttttcctgcgtgatctgttgttacaacccgaaattaatcaggtgacttgtctggtacgtgcacatgataatgatgcagcgttgcttcgggtcaagaaaaaccttaatcaatacggggtgtggcaggacgaatttctcccccggttgcaggttattgccggcgatattacggagcctctgctcgcaatgaacccacagacttataagcgcttatctgtagaatgtgatgtcattttccatttggcggcacatgtcaattatattcagccttattcagcccatcgcgccggaaacgttgtagggacgctgaatctattacgcttcgcggtcagtgaaaaagtcaaatcttttcattatatctccaccattactgtgtttggccctgccggactgctgtcgcctatatccacaatctatgaagatgacgacatcatgccttacttagacgccatgagatatgattcaggatattcacaaagcgaatgggttgttgaacggataatatggcaggccagagacagagggataccgctttctgtatatcgtcctggttttatcatgggtgacagccagacaggggcaggcaaccccaacgattctatcgcccggttactcaagggatgtatagaaataggcgcctatcccctgttagttaaccagcggagagaattcgttccggtaaattatgtcagttcagccttactgaatatctctcgtgacaacaatcgattaggcagggcttatcatctagttactcctgacaataagcactctgtcgattttaatcaattttttgagttactcaaacagtgtggttatcagctcaacgggttagattattctgagtggctagagaagttggaagcagatcccgcactggtggataatccattaatgccattgatacccatactatctgaaaagatttatgggcagcttacccgatgggaggtgtatgaaaatatgccggcgtatgatgcaaaaaatacaaatatagcattaaagaaaatacataaattatatgcaccaatggacagtcatctgctggaacgctacctttcttattggagacgtataggctttctgtcataagacaaatagtaataatgtcgaaatagtgaatcatttttaattaccaaaaaatataattaagtatttattcagtaacaaagttacagaattatctaaatatataaagtaacaaaaaataaaattcactttcgtatgattttatttatcttaatgatattactctgcacacatataagtattatcatatattacatggatgaattaaaatgttttacattgttctttctaatgttccctataaaaatccaggttaatggaatataaaacatcagaatatatacaagcaatgaatgatatggacgcctccaaaaaacataaggaattttaaataattcttggaaaataaataaccttttatcaatcattgaactattaaaaatatattataatcagatgttgaacttaaatacagaaagacgcattaaaggcgtctttctgcttttttatatccttcatctttcaaattacagcttcgttggctacaaattgaaatctattaggtataaatcaggaattaatattgagtaaacatttcctgaatttttgctggatcagaagtttgagtcagagccagttgcagaagaacacgagctttctgtgggttcaaacgctctgatgcgacaaaaccatatttgctgtcgttaacttcagcattcttggttgtataaccaaaaggaatacggctggatctgacaacaaccacaccatctttagcggcttgagccaaggtgtcaaaaatggatttatagatattaccgttacctacacctgcgctgacaataccctgatagccattttccacgaatgcttttgctggcaattcggaagcattagagtagttataaacaataccgacttttggcagtttatccagtttgctgacatcaaaagcggctttatgcgctttttctggtgcagcagtagcagagtagtaactcactttgccactgtgaacaaaaccttctgctccgctattgatagcctgaaacgcctgaacttcagttgtgctcagtttgccaatatgacgaccgtgaatcacagaatcattcatagccagcaaaacaccgcggtttgcagagcttttatctgccgcgacaactacggcattatacaggtttaatgggccatcagcacccagagctgttgatgggcgcattgcaccaaccatcacgattggcttctggcactgagtggtcaaatcaaggaagtaagcggtttcttccatagtgtcagtaccgtgggtaactacgaaaccatcggtcttatcacaatctgcgttgattttttttgccagagtcagccaaacctgatcattcatgtcttgagaaccgatgctgacaacctgttcacctttcagatcagcgatgtttttaatcgcgggtacagcattcaacagtgaatcaataccaactttacctgcagtatagctagattgagttgctgactcgccaccaccagcaattgtgccgccagttgccaaaacggtaatgtttggcagagcaagcgcagaaccactaactaacgtcagaaagccggctattgctgtttttttagtctttttcatgatttaaccttttgtaaaaaaagccattttattatgtaaactggaaataaataaactccaattaacaataatttttgggaattgatagagcagacaaaaaaaacgccgtatgatatgcggcctttaacaaaaattgaagtgaataacgatgacgcaaacctatatccccggcaaagacgccgcgttggaagattccattaaccacttccaatccaagctgacatctcttggttttaatatcgaagaagcctcatggctgaatcccgtacccaatgtctggtcggtacatatccgcgatcgcgactgcccactgtgctttaccaatggcaaaggagccagcaaaaaagcagcattggcctctgcattaggggaatattttgagcgtctgtcgacaaactattttttcgctgatttttaccttgggaatgccgttgctaacggggaatttgtccattatccaaacgaaaaatggtttccattgccggaagatgattccctgccagagggcattttagacgagcgccttcaccatttctacaaccctgacaacgaactctgcgccagtcaattgattgattttcaatccggcaatgaagagcgcgggatctgtgccctgcctttcactcgccaatccgataatcaaaccgtttatattccgatgaatattatcggcaacctgtatgtctcaaacggcatgtccgcaggcaataccatgaacgaagcgcgcgttcaggggttatcagaagtgtttgagcgctatgtaaaaaaccgcattattgcagaatgcatcagcctgcctgaaatcccagaaagcgtaatgaatcgctatcctagtgtagttgaatccgtcaataaattgcaggcagaaggcttcccactctattgctacgatgcctcactaggggggcaattcccggtaatttgcgttgtgctgtttaatccgaataatggcacttgctttgcctcttttggcgctcatcctgattttggtgttgcgctggaacgtaccgtaaccgagcttctgcaaggccgcagcttaaaggatctggatgtctttacgccaccaagtttcgatgatgaagaagtatctgaacataccaatctggaaactcacttcatcgattcaagcggtgcgattagctgggatctattcaaacaggatgccgactatacatttgccgattggagtttcaaaggcacgacagaagaagaatttgccacactgatggggatcttcaatacgctggatgctgaagcttatattgctgattacgaacatctggacgtttatgcctgccgtattctggtgcctggcatgtcagatatttatccggttgaagatttgcacatcgccaataataccatgggaactcatctgcgtgagactattctggcgttgccaaatagccagtggcagccagcagaatatcttactttccttgaacaattggatgatgaagggctggatgatttcacccgtgtccgtgaattactggggatcgccgcaggtaaagacaacggctggagtaacctgcgcattggtgaattgaaatccatgctggcattggctggcaacgatctggaacaggcgttgatctgggttgagtggacacaggacttcaatgcttcggttttcaccgccgaacgagccaattattatcgctgtttgcaaacactgctgctattgacccaagaagaagatcgtgacccaagccaataccatcaggcttttgtcaaaatgtacggtcaggaaaccgtcgatgctgcctccgccgccattgacggcaaaaacggcttctacggcctatggtctgtagattcagagctaaaaacattgccagcacatcaggcattactcaatgcttatgaaaaactgcaaaaagccaaacgcgagttttggtcaaataaataaaccgttacattaaagtttatttattataaaaagtaaaattcaggttaaattaagtttatttaaaaataacaaataaatgacaatttaacctgttattttacgtttttaatattctcaaaaatctttcatataaaatatttttataaattttaaaaatatttaatcattataaatcaatatattaaaatataacagtcgcatttaaacccccgtaattccccagactttctgcgtaatatgatccatgtcaaattcaggtcaatgctcgtttgttactatcattacgtgctaaaattaattaaggataaagagagtgttagtatgaaaactgacaacccttttaatttatttccacctgctgtaatggcacaaatcgctgatgatagtggtgtatataaagttaataaacatcccgcagtgacttatttatcggcaatcatggcaggtgtgtttatttccattgcttttgtcttttatattacggctaccacaggaacatcttccattccttatggattagcaaaattaactggcgggatttgcttttctcttggtttaatgctggtggttatatttggtgcagatcttttcacctccacagtattgactatagtttcaaaagccacaggccgtatcacctggtcacaaatgctcaaaaattggattaacgtttatatcggtaatctgattggtgcactattttttgtcattttaatgtggcaatcaggccaatatgcggtcgctaatggttcctgggggctgaacgtattacagactgccgatcataaaatgcaccacacctttattgaagcagtatgtttaggcattttggccaatctgatggtatgccttgcggtctggatgagctatgccgggcgcagcctgatcgataaattgtttgccttgatcctgccagttgccatgtttgtcgccagtggctttgaacacagtatcgccaatatgtttttaattccgttcgggatcattatcaaaaattttgccccaactgaattctgggcaaaagtgggagccactcccgaacaatttcctcaactcaccgtttcacactttattactgataacctgatccctgtaacgataggtaatattattggtggtgcgatattggttgggttgatttattggttcatgtatttacgtggcggccaaaaatattaattcgcctccacgtcaggtttcttaaaagttccactgttaaaaggtagaaatatcatgtccgagttaaatgaaaaattctctgtagcatggcaaggctttaacgagggtagctggcaaaatgaagtcaatgttcgtgacttcatccagcagaactatgctccgtatgaaggtgatgaaacattccttgcaggcgccacaaaagcgactgatattttgtggaaaaaagtcatggaaggtatcaaaatcgaaaaccgtactcatgcgccggttgattttgatactgatgttgcgtctacaattatttctcatgatgcgggttatattgccaaagacctagaacaaatcgtaggcctgcaaaccgaagcaccactgaaacgtgccattattccattcggtggaatcaaaatggttgagagttcctgtaaagcttacaaccgtgaactagacccaaaactgaaacaaatttttactgactatcgcaaaacccacaatcagggagtattcgatgtttatacacctgatatcctgaaatgccgtaaatccggtgtactgacaggtttgcctgatgcctatggccgtggccgcatcatcggtgactaccgccgcgttgctctgtacggtatcgacctcctgcgtgatgaaaaatatgctcaattcacatcattacaggaaaaactggaaaacggtgaagatctggaagccactatccgtctgcgtgaagaaatcgctgaacagcaccgcgctcttagtcagattaaagaaatggcggctaaatatggctgtgatatttcctacccggcgatcacagcgaaagaagccgtgcagtggacttacttcgcttatttggcagcggttaaatcgcaaaatggtgcagcgatgtctttcggtcgtgtgtccagcttcctggatatctacatcgaacgcgatctgcaagcaggcagactgacagaacaagaagctcaagaactgattgaccatctggtcatgaaattgcgcatggttcgttttctgcgtactccagaatacgatgagttattctctggcgaccccatctgggcaacggaatcactagcaggtatgggcttggacggccgtactctcgttaccaaaaacagtttccgtttcctgaacacgctttatactatggggccatcaccagagcctaacatgaccatcctgtggtctgaaaaactaccaatcaacttcaaaaaattcgcagcgaaagtgtctatagatacctcatccctgcaatatgaaaacgatgatctgatgcgccctgatttcaacagcgatgactatgctatcgcatgttgtgtcagcccaatgattgttggtaagcaaatgcaattcttcggcgcacgtgccaatctggcaaaaaccatgctgtatgcaatcaacggcggtgtggatgaaaaaatgaaaatacaggttggcccaaaagaagaaccaatgagagacgaagtgctggattatgacaaagtcatggctcgcatggatcatttcatggattggctggcaaaacagtatgtcactgctttaaatatcatccactatatgcatgacagatacagctatgaagcggcactgatggcactgcatgaccgtgatgtttaccgtaccatggcatgtggtatcgcgggtctttccgtagcggccgactcactgtctgcaatcaagtatgcgaaagtttctccaatccgtgatgaagatggcttggcaactgatttcaatattgagggcgaatatccacaattcggtaataacgatccgcgtgtcgatgatatcgcctgtgatctggttgaacgctttatgaagaaaattcaaaagctacaaacctatcgcaacgcagtgccaactcagtctgtactgaccattacttctaacgtggtttatggtaagaaaaccggtaacactcctgatggacgtcgtgctggtgcaccattcggccctggtgctaatccaatgcacggacgtgatcaaaaaggtgcggttgcctcactgacttctgtcgccaaactgccatttgcctatgcgaaagatggggtttcgtatactttctctatcgtgcctaatgcactgggtaaagacgatgaggtacgcaaggcaaatctggctggtctgatggatggttacttccatcacgaagcgaatatcgaaggaggccaacatctgaacgtcaacgtgatgaaccgtgaaatgctactggatgcgatggaaaacccggagaaatatcctcaattgactattcgtgtatctggttacgccgtgcggttcaactcgctgactaaagagcaacagcgagatgtcatcactcgtacatttacccagacgatatgattaagaaaaatagcattgtccaaaaatgtcattattttctattgaaataaaatgacatacactaaaggccccttcacaattggggcctttattatcctgtcagtttttggagaaacgccttcatgtctgtacttggtcacatccactcttttgaatcttgcggaaccgttgatggcccaggtatccgttttatcgtgtttttccagggttgcctgatgcgttgcctttattgccataaccgcgatacatggaatacccacggtggtataaccgtcactgttgaagagcttataaaagaagcgacaacttaccgtcattttatgaatgcctccggtggtggtgttaccgcttctggtggagaagccattcttcaggctgaatttgtccgtgactggttcagagcttgtcatgcagaaaatattcacacctgtttagataccaatggctttgttcgtcgttatgatctcatcattgacgaactgctggacgataccgatctggttatgttggatttaaaacagcttgatgatgaaattcaccaaaaactaatcggggtttccaatcatcgcactctcgaatttgcccactatctggcaaaacgcaaccaaaagacctggattcgctatgtcgtggttccggggtggtcagacgatgataaatctgtccatatgcttggtgaatttactcaggatatgaagaatattgaaaaaattgaattattaccttatcacgaacttggcaaacataaatggattgctatgggtgaagaatataaattagaaggagtaaagcctccttcaaaagaaataatggaacgagtaaaagaaatcttagtgagttatggacaccatgtaatctattaagcccctcctattttctttatttaattaacctggcttaaaacttagtttcagtcaggtttttctaaaaataatttctattatttaataattttttaaaaaaatagatatcatctatgcaagatgcttatggcattaacttaaaataaactaaaaaattgaataaatagtttatcccgacttaatctttataaatgacaatgaattaccataacatcagacggataccagcctgatattacccaaaataaatgatgcaatttatgtatttttatacccattttcagttaggcacctcacaactaataatgagtatataaattattattctatcactcaaatagtgaataatatttctattgtttatctattaaatagagagtaataaactaaagcttagattttatctgacaaaaatattttcatctaaaaatacacaatatttcatatttaagtataaaaatttcatttcatacttaaataaatcaataagttatacataatcagcctaaccaaaaaaaataaaaaattctgtatattccgaaaaataggcaaaattagtatattaatcccccaatcaaaatcacaattaatgcttgttgaacagtaatttttatatgataatttatgagtttctctaacaaaatgtgttaacgggatgattgtagagaaaattaatttggcaattaccgttcaataagataaatcggaaaaaaatggacaatcaagatatcaatttcaattctggggaaaaaaacgtttccctaaccaaagaaaagagcacattcattcctggtggtcgagcagtaggggctggagcagcaatagaatggattggcaatgcatggcaaatggttaaagcaaacccaatgatgtggatactgctgaccttcatctatatggttatcattgtaggcttgcaatttattccattcctcagtttttttactgccttacttggttctgtgtttattgctggtttcatcgctgccgctgaaaaacagagaacaacaggtaactttgagatagagttactcttccacggtttcaaaaacaaatttggttcactagttgctgttggtgggctagtctttggtatatacctgcttggtgttatcgccgctgtcattattggtggtacaagcatatatcaactgattttagccagccagtatgccgatccagatccagcactgttactaggtagcctttcttctataatgctggcagtccttgttttaactatctttagtatgattgctcttgcatttagctggttcgcacctgccctgattatcattaatgatctgaaattcggtgaagcggtgtcaatgagcctgagtgcagtgaagaaaaacctgttcggtggcttcctgtttttcttactggtgggcattctggttggtatttccatgatcccattctttttaggtatgattattactattcccatctatatggcaactttttatacgacctatcgcagcattttttatacggaagaagtgaaagaacagaagtctagtttaatcagctaatgaatttttaataagtatcgataagcaaaaaggcgctatttcggcgcttttttgctatcttgtaacattattatctatttgaatagataaaaaaataaaccaataacaaggaataataatgaaagataactatcttaattttaactcaaaatcaataaataacatcctttagaagaataaaaaatgaacaataaaaatattgatttcagttcaaggtcgagaaatgtttccttaaccaaagataaggagacatttattcctaatgggcgtgcagcaggagccaatgccgcaatagaatggattagaaattcatgggaaatagttaaacccaattttggtaattggatactattgcttttcctttatcttatctgctttaccattatcttattggtcccatttatcaacctcattgctttatttattgcccctgtattcatgggtggttttatggctatctgtgaggaatatagaaaaaagggtagttttaatataggattatttttccacgggttcaaaaaaaattttggttcactactagctgtcggcatattcactattcttattttaactgttggagtactcgcagccatagttatcggtagcgtaggaatatatcaattttaccttatcggacaaggtagtgagattgatatagccatggttcttctcattttctttatatttattttgatctatattgctataatatttttttctatccttgggctagcttatacttggtttgctcctgcactgattgtcattaatggcttaaaattcagtgatgctatatcaatgagtttcaatgcagtgaaaaagaatcttcttggtggttttatctttttcttattaatgaatatgatcataactctttccataatcccattaggcttagggctatttattaccatacctatttatttggcagcttactatacgtcttatcgtagtatcttttatgtagaatcaaaagaatctgaaaattgataggttcaatataaaatattttttacaaaaggaacttaaagaggatggatataaatcattaccgataaaaaaagcgcccaacacggcgctttttttattatttagaataatgggtaattaaccaatatattccagccctttcatataaggacgcaatacttctggaatttcgatacggccatctgcctgctgatagttttccatcactgcaaccagagtacgacccacagccagaccagaaccattcagtgtatgcactaactgggttttcttgtcatctttgctgcggaaacgtgcttgcatacgacgagcctgaaaatcccacatattagagcatgatgagatttcacggtaagtattctgcgctggcagccaaacttccagatcgtaagtttttcttgcgcttgcgcccatatcacccgtacatagcaacatcttgcggtaaggtagtttcaataactgcaatactttttctgcatgtccagtcagttcttccagagcatccattgatttttcaggatgggcaatctgaaccaattcaattttatcaaactggtgcatacggatcaggccacgagtatcacggccataagaacccgcttcagagcggaaacaaggtgtatgcgccgtcattttcagtggcaatgcactttcatccagaatatcaccacggacaaggttggtaaccggcacttccgcagttggaatcaaggcatagttgctgccggtttcttcttccaatggattggtgtggaacagatcttcaccaaatttaggcagctgaccagtgccatacagcgtttcatgattaaccagataaggtacataagtttccagataaccatgctgttcggtatgcagatccagcatgaactgtgccagtgcacggtgcagacgagcaatctgacctttcattaccacgaaacgcgaacccgttaattttaccgcagcggcaaaatcaagaccgttggttaattcacccagtgatacatgatctttaacttcaaaatcatattggcgtggctcgccccagcggctaatttcctgattatcactgtcatcttttccataaggagaggaatcatcgggaatattaggcattcttaatgcgagctcacggatctctgcctgcaatgcttccaattcagctttcgctaaatcaagtttttctcccaactgattcacttcctgacgcagtggttcaatatcttcaccacgggctttcgctgcaccaatagccttcgatcgggaattacgttctgcttgcagggtttcagtttcaacttgcaaaactttacgacgctcttcttgtttacacagcgtctccacatcaagggtataacccctgcgagccagtttttcggcgactgcgtctagctcattacgcagcatatttggatcgagcatgctattcctgtgcttgttattgaaaaaattgttattgagaaaaaagtggtgaaatcagctcggattgaccaagccgacacatatacccttaccgcataaaccttaccgtatcaatggcattagcggtagcgttttatctggctatttttatcctgttcaattagccagtttaatttatcaccgattttaccttccagccctctggctgtcggatgataatagcgagtctctcgcatttctggtgggaaataaacttcaccagcagcataagcattcggttcatcatgggcatagcggtatgcttcaccaaatcccatttccttcatgagtttggtaggcgcattgcgcaaatgtgcaggaacgtcataatccggcttatcttgcgcatccaccatcgcggccttgaatgccatataaaccgcgttgcttttcggagcgcatgcgagataaacaatggcctgtgcaatcgcccgttccccttctgccgcgcctactcgtgtaaaacaatcccacgcggcaatggctacctgcatacctcgcgggtcagcattacccacatcttcagatgcaatggctaataaacgacgggcaacataaagcggatcaccgcctgctgtaatgattctggcgtaccaataaagcgcagcatccggcgctgaaccacgtattgatttatgcagggctgagattaaatcgtaataccgatcacctttattatcaaaccgcgcactccgttccccgctgacctctttcagtaactccggtgtcagaactcgttgcccctgtgcattggctttcgccatatctgacatcatttccagcaagttcaatgaacgacgagcatcacctgcaaccaattctgcggccatctgacgggtgtcgtcctgcaacacaatattttgcccaccgaagccacgttctttatcattcatagcctgaaaaagcacttgctcaatttcggctgctgacagtgatttcagtaagtagacacgagctcgtgacaacaaggctgaatttaattcaaaggaaggattttcggttgtcgcaccaataaacgtgatcgtgccatcctcaatatgcggtaaaaaggcatcttgctggcttttattaaatcgatggacttcatcaacaaataagatagtcctgcgacctgcattacgattttgactcgctttctctatggattcacgaatttctttgataccagatgtgaccgcagaaatacgctcgatatcggcttgcgcgtaatggccaataatttcagccagcgttgttttccccgttcctggtggtccccacagaatcatggagtgaagatgacccgcgcggattgctcgtggcaaaggtttgccttccgctagcaaatgttgctgaccgatataatgatctaatgtgactggccgcattctcgcggccagtggctgaaattcattttgtgaaaaatcgagtgaaagattgttcacttaaacctcactaacgctgatcatccaacgtgacgccctctggcatggtgaatttgaattttgattcatcaacgcgggtattttgctgcccttttaattgataagcacttttttgtccatcttgttcaaccgctgtaaatttctggatagtcccctccggcgttacagtgattgaaaaatgtttcaaatttccattggcgttactaggcgtcaactcgaaattattgccactttgtacaacgttatattgcttccagtcagcagaatcattacgggcaatcaacataaatggtgtattgcctgcagcatcttttaaccaattagcggtcacttgttcaacaaaggggttatagaaccacagtgtttttccatcagaaaccaagacactctcatcaggcgatgtcatgtgccagttgaacaaattaggacgtttgacccaaagttgcccttcaccgttttggatcgctgaaccgtcactgctagtgacggtttgggtaaaactggcgtgaaagctattcaccttacccaagcgaccttgtagatcctgcgaggcatcagcccatgcagtacccacactcacacccatcatcagacaaccaatcaacatcagttttttcatgtgcgagataccttcaattcatatttattatcagcattaatagccgataccgcatttaaaagtgacttatcaatgttcatgcggcggaggcgctaagacttcacgattgccattgtgaccaggggtactgacaatctgctgtgcttccatctgttcgacaattctggctgctcggttatacccgatgcggaactgtcgttgtacaccggaaatagaaacccgacgtttttcggtcacaaattgaaccgcctgatcaaacagaggatccaattcttcatcgctatccaatcccagaccaccttcaccgtcttctccacccttgataatactatcaatatattgaggacgaccacgggctttccagtcgttgacaacttcatgaacttcctgatcgcgaacaaatgcgccatgaacacgtacaggaatagaagagtttggtgccagataaagcatatcccccatgccaagtaatgattctgcaccaccttggtcaagaatggtacgagaatcaattttactggaaacggtaaatgcgatgcgcgtcgggatatttgctttaatcagccctgtaatgatatcaacggaaggacgctgtgttgccagcaccaagtgaatacctgcggcgcgtgctttctgagccaaacgcgcaatcaattcttccacttttttccctaccgtcattatcaagtcagcaaattcatcaaccatgacaacgatataaggctcttttttcagcataggatgagttacatccatactgtcacccggtttccagaaaggatcggggatcgggcgccccatattttccgcttgtttgatcttatcgttatagccggcgagattacgcacgcccaaagctgacatcaacttataacgacgttccatttcgttcacacaccaacgcagcgcattcgccgcatctttcatatcagtgacgacttccgtcaataagtgcggaattccttcataaaccgacaactcaagcattttcggatcgatcataataaagcggacatcttccggttttgctttatacagaatactgaggatcattgcattgacccccactgatttccccgatcccgttgtccctgcgaccagcaagtgaggcattttacccaaatcagcaaccactggctgacctgcgatatctttccccagaacaatagttagtggcgatgggttgtcacggaatttttcacagtccaggacttcacgcagataaactgtatgacgttttttattcggtaattccaagcctacgtaaggtttccccggaatgacttccacgatacgaaccgccaccgcagagagtgagcgggcaaggtcacgcgacaagttggagatacgggaagccttaacccccggcgccaaatccaattcaaatcgtgtaataaccgggcctggtgaaaacccaacaacatccgctttgatgcgataatcattcagacgcacttcaatcagacgtgaagtctgttcaagggcaaacatatcgacgggttcttcttccgcgggcggtttcgccagaagatctaaagaaggcatcggtgttgttggctttggcaatggttgatcattacgcatcaagaatggatggaacaggctcgactgctgcggttgctgcggttgctgcggttgctgcggttgctgcggttgctgcggttgctgcgcaaaagtatgctgaattttcgattcatgggaaggccctgaaacagaaactgttcttttttcctgttctgaacgaatcgatgactctgactgcaggggcaatagctctacaggttcagatttttcaaaaccatcagccagtgaagaataatcaaacgcaggcttttcggcctggcttggaatagcaggctggatcttttgataacgttcacgctgctgctgttcgaacgctactcgcaatgcctcttcctgttccgacggttcatcaacactatgctctacaaattcggctgtcgctgattgcttatgtatctgagcgatttcttcacgatgcccttttgtttcttcttcaaaattagaaccataacgttcacgctgctgttcaaggaattgctgccgcaacatgtcttgctgctgttcatccatttgctgttcatcagtttccgcaataagatcgctttgtctctctttttcttcccgttgcagatgttcagacaaacgctgagacggtactttgacaccatataattcacggcgggtaggtattctaacgggattcggccgcggcatttcagggccaataccctgtttcatctgaggagttttcatcacaacagcagcactggaaacaccagcggccacatttttcagattatcattcggagaaaaagtaaacgactctatcacatcattttgtggctgtatgtttgttgccacagtgctatctgtagataactctgattgtgcagtaatctgtgcagttttactgaattctgattctgtgtctaattgataatcagctggcagttcaaatgtataatgaacaggttcttgatcttcttcagtatgatccgattcagtttgtactgattccggtaaggtaatggcttcctgagcaatagattgctgcctgttttcgttttgctgcacaggctgaaccttttcaggtgaaccgctctcctgcgctgtatccatagcttgagacgctgaaatagctggaggcgctgaatcagtcttaaccagttccaccaccgttggcgcactcaacagcacgtcatcctcgtcaacttctacagctttagcggcagatgctgtcatgcctatatcatctgtgtttacattatcagcacgattttgcccgctggccagatgttcaggaataacttcgtcttccagttcgccatactcaggctcattgcgggtgcaatttaccataaaactgagtgattcaagaataactgcaccaattttttccgcaatagtgagccatgaccagcctgtaaataatgtgaacccaatagcccaaataccgagcagcgctaatgtcgccccaagaatattaaaccacggcagaatcgctttactgaataagttaccgatgacaccaccagcagcaaaatcgtttaaatcatcaatattgagagcaaccaggccacatgaagttaataccagtgccaaagcgccaatgacgcgtaatgcgagcgtaaagaaatcaacatactcttgcctatctttctgacggaaagcattccaacaacctaaaaacataaatagcgggactgcataggcaagaataccaaatgccgaaaatagtatatctgacaaccaggcaccaacactgccaccgaaattatggacgggcccattccatgacgtttgtgaccagctgggatcggagggattgaaactgacaagcgccaccataaagtacacgacgcaaatagcaataaccaacagaatggcttccagaagccgacggctactgcttattttctttaacttaacacgtttatcttctgtatattcctggttcaagaaaggctctccaggttttcctgttgattaaatggaacaacgctgaggattgctcagcgttggaactgtatgcataaacaggagtgtacctaagtttttcctgttttgcatctgtacattttagacaaaagtttagcgagttttaatgactaaacggttactctgcttcacttcttccatgacaacataagtgcgggtgtcattgacgcccggaaggcgcagcagggtttcgcccagtaatttacgatatgcagacatatctggcactcgtgttttcagcaaatagtcaaaatcaccagaaactaagtgacattcttggatttcttcaagtttctgtacagcagtattaaactgctcaaagacatctgctgcaccacggttcagagtaatctccacaaataccaatagcgatgcatccagataatgaggattcaacaaggcggtgtaaccagaaataaagccctgacgttccaatcggcgtacacgctccagacaaggcgtaggtgataaaccaacccgcttggataattccacattagaaatacggccgtctttctgcaattcgttaaggatattacggtctatgcgatcaagatcttttcctggacgcttcttattatctatcatcttattgctctctctttatattcctacacccataacattttccctatctctctcaagcagttgagctgaaaaagatgtctttcaaaggctaaagctcaatctgtaaccaaggtttgggatctatacgccatcttctaaaatacaatttcccagaactcgattaaccaaaacacgacttactagaacaccgtcttccagaatattatttcccaaaacactacgtctcccagaaagcagcttatcggcaatttttttgttctataagaaaactacccactccgatttgtctattctatagaaacaattgattagcgaggtagataattatctcttacacagatgttttcgcaaatgcacagctgattgtcaaagtaaatgaacaaaaatcagaacaacctaccaaacaaattttgagtaaatcctttccatagcttgttttataccttatacggataaatgatgttcaattcagaaagttaagtaacctctccttacattcccattacatcatagttactatctatcggtaaaatcgttaataacataaatattttatctgataatcgctttttttaacttattatttctcctacaatccccaaatccgcaatatgcgataatggaaatgaggtattcatgagcacagccaaacacagtaaacttatcattcttggctcaggtcctgctggttataccgccgctgtttatgcagcccgcgctaatttaaaccccgtccttattaccggggttgaaaaaggcggccaattgaccaccacgactgaagttgaaaactggcccggtgatcctgaagggctgacaggtccagatttgatggaacgtatgttccaacacgctgaaaaatttcaaacagaaattatttctgaccatattcagaaagtcgatttcgaaaaaagaccattccgtctttatggagatgatcaggaatatacctgcgatgctttgatcatcgcgacaggtgcttccgcccgttatttgggtctcccttccgaagacgctttcaaaggtcgtggcgtatctgcctgtgcaacatgtgatggtttcttctatcgtaagcaaaaggttgctgtagttggtggtggcaataccgccgttgaagaagcactgtatcttgcgaacattgcagccgaagtccatctcattcaccgccgtgatactttccgttcagaaaagatcctcattgatcgactgatggagaaagtcaagaatggtaatatcattctgcataccgatagaactttagatgaggtgctgggcgatgatatgggtgtgactggcattcgtattcacgatacgaaaagtgataatgcagaagagctggatgttactggtgtcttcattgctatcggccacagtccaaacacaggtatctttgaaggacagcttgaactgcaaaacggatatattaaagtccagtccggcctgcatggaaatgccacccagacttctattccgggagtatttgccgccggggatgtcatggatcatgtttatcgccaagccatcacctcagcaggtactggctgtatggctgcactggatgctgaacgttttcttgatggattggcaactaaataaaccctctttctttaaggcgctatttcggtagcgctttttaacagggaacataaggtttggccgctggcaaacagtatcaccagcctttttgatacattgtatcatcacctgctaatcagaaatttttcttatggacaaaacaagacaatctgaacttgttcgatggctaagacagcaaagtgcgcctgcccgtcggtggcttcggctatccatgctacttggcctcattagcggattactaatcatctctcaagcttggcttctggcgtcaatccttcaagcactaatcatggataaaatcccccgcgaaaatctcatcgttcagtttctgatgctgatagccgcctttacattgcgggcaattgtcagtgctactcgagagcgtatcggttttatctgtggcaaggttgtgcgccaacaaatccgcagtatagttttggataaactggcacaattggggccggtttgggtcaagggaaaacccgccggaagctgggctaccattatcttggaacaaatcgaagatatgcaggatttttattcccgctatctgccccaaatggcgcttgcaaccattatccctctcttaatcctgatgactgtctttcctgtcaactgggcagcaggattaattttactcgttaccgctccgttaattcccctttttatgtcattggttggattaggtgccgctgacgccaatcgacgcaattttgtcgcgctcagtcgtttaagcggcaatttccttgatcgtttacggggtctggaaactctacgcgtgttccatcgcggggaagccgaagttaagcaaattaccgaatcgacagacagtttccgtcacagaacgatggaagtactgcgcatggcatttttatcgtctgctgtgctggagttttttgctgcagtttccattgcggttgttgccgtttattttggtttttcttatttgggagaattacattttggtagttatggtctgggtgtcacgttgtttgcaggcttcctcgctctgatcctcgctcctgaattctttcagccactgcgcgatttgggtacgttttatcatgcaaaagcccaagctgtcggtgccgcagagtcgctttttactctgctcaacagtgatggagaacacactgtatccaacggcgaaaaaatgctgccagatacaaaatcagtgactattgaagcgaacgaactggaaatccggtcacacgatggtcatcatcttgcgggtcccttgagcttcacgattgacaaacatcagcggattgcgttggttgggaaaagtggtgctgggaaaagctcgctgatcaatctattactggggttcctgccctatcgcggctctttgaaaatcaatggaatcgagctacgtgagctgaatctaaccaaatggcgtgagcagttaagctgggttggacaaaacccacacctgccagagcagacgctgctcgataatatccgtcttggtcaatttgacgcaacacaagaccagattaatgatgttatggaacgggcttatgtcagcgagtttattcatgctcttcctgaaggcgtgaatacagtcattggtgacaatgcagcccgcttatctgttgggcaagctcaacgcatcgctgtagcacgggcattattgaacccctgtcagttattgttattggatgagccggcagccagtcttgacgcccatagcgaacaacgtgtgatgatggcattaaatcaggcatccagtcagcaaaccacactgctggtcactcacctgctggaagaaacactggaatatgaccagatctgggtaatggaaaacgggttaatcattgagaaaggccattatcagagtttaagccaatctcaaggggcattttcccgtctgttgtctcatcgcagcgtggagctttaatcatgcgtatattactcccatttctcgcactctatcgccgccactggtttctcatcagcttgggcatggtattagcggttgtaaccctgttagccagtattggcctgctgacgctttccggctggtttcttgccggtacagccttggcaggattcgcggggttatatacgttcaactatatgctgccagccgctggcgtccgtggtgcagctattttccgtactgctggccgttatggtgaacgactggtcagtcatgatgctacttttcgcgtattggcacatctacgcgtttttgcctttcagaaaattttaccgctttctccgggaggcatcgcccgttttcgtcaaggcgaactactgaatagaatcgttgcggatgtcgaaacgcttgatcacctctatctgcgagtcatctcccctgtcctttcggcgttggttgtgattgttgttctgacttttggcttgggttttcttgatgtcaccctcgcatataccctaggcggtattatgctggggctactgatgatattgccttttgtgttttatcatgcaggaaagccttatggcagagacatcaccctactgcgcggtcaatatcgtacattactcactagcgcgttgcaggggcaggctgagttgacagtgtttggcgcacttgggcgttttcgacaatcaatgacagacgttgaatccgattggctgaaatgccaacaacagcaagccaacctgacggggctttctcaagccgttatgattttcgctacaggcatgacagtgactctgctactttggctagcagcagcaggtgtaggggaacatagccaacctggagcactgatagctctatttgcgttctgtgctctcgctgctttcgaagctcttggacccgtcacagtggcatttcagcatatgggacaggttatctcatctgcaacccgtgtttctcagttaatgcatcaggagccagaagtcactttccctgctcatgggccacaaacaactgacagcctcaatcttgagataaaaaatattgatttcacctatcctgaacaacctctaccagtattgaagaatatttcactgtccctgacatcaggcgaacatatcgcactattggggaaaacagggtgcggtaaatcgacacttttacagttactgagccgtgcatggggtgttgatcacggcgaaattcggctcaatcaacaacctatttcccagtatgatgaagctacattgcgatcaatgatgtctatcgttcctcagcggatacatgtcttcagccataccctgcgtgaaaacctcttgttagccaaaccggatgccagcgatgatgagttagaaatcgtactcaaacaagtgggtttagggaacttgctagacaataatgaaaagctaaattgttggatgggtgaaggtgggcgccagctttccggtggggaacaacgccgtttggggattgccagagcgttgttacacaatgcaccattaatgctgctggatgagccgacagaagggctggacgccgatactgaacaacagattctgtctctgttacgccacagttgccagcacaagacactgattgtggttacccatcgattaacaggtttacagcatatggatcgtatctgtgttatggatgagggacgcatcattgagcaaggcaaacatgatgtgttgctggctcagcaggggcgttattatcaattttatcagcgacagagctatcttgagcaggagtaatcatttttatgtcgatagctcaactgggtaactcatatgcatttcctcatccaacccatgcgctggttgaaccaaatggtttactggcatttggtggtgatctatgcgcagagcgtttaagggtagcttatcacgaaggtattttcccttggttttcccctgatgagcttcccctatggtggtcgcccgacccccgagcggtcctaattccgggtgaattacatactgggcgcacgctacgtcgttttattcgcaaacttccttaccaaattacggtaaactatgctttcgatcaggtgatatatggttgtgcccaacggcaagaaggcacttggatcgggtctgatgttcagcaaggttatcaggccctgcatcaagaaggtctggctcattcaattgaagtctggtatgactgccaacttgtaggtggtttatatggggttaatgtaggtacgctattttgcggagaatcgatgtttagcaaaatggagaatgcatctaagtgtgcttttgtggcattctaccaccactttttacatcatggtggccaattattggattgtcaggtactaaatcaccatacgaaatcattaggcgcaaaaaatattccaaggaaagaatttctccagcatctttacttatgcagagagcagtcattgcaggcaggatgctgggctgctcaaatgctggatttatagtcaaaatctagtgatttatgctgttcacggcgggaatgtcgatatccattatgaggaaaatgatggtttaaaatacgacattcctttacataatgagggtttttcggcattatcttgccgtttaaaaactatggttgttacatttagaggattagatggccaaagaagacaatattgaaatgcaaggtactgtgttagacacactgccaaacaccatgttccgtgtcgaattggaaaatggacacgtcgttactgctcacatttcaggcaaaatgcgtaaaaactatattcgcatcctgactggagacaaggttacagttgagctaaccccatatgacctgagcaaaggccgtatcgtcttccgtagccgctgatttagatactgttttaaacaccacaggtgataattttttcgacactcacctgtggtgtcccccgactattcttatcaactttccagtacatttctttaaaatgtggcctgttttatagcaccgcatcttccgatttctttttactcgacttttgtgcacttctgaaatcgtatatcagtgcccgtttgtctttatcaagattaatcctaaccgaacctccatgtatcaacgaaccaaacaacagttcattcgccaatggtttcttgaggttgtcctgaatcacccgagtcattggacgtgcgcccatcgctctatcgtagcctttatcacataaccactgacgggcatctgcactcacttccagagaaacacctttttcatccagttgtgcttgcagttcaacaatgaatttatcaacaaccagttgaataacttcagcggaaagtgcatcaaaccagatgatgccatcgagacggttacggaattcaggtgtgaagatccgtttgatctcttccattccatctatgctgttatcctgctcagtaaaaccgatggatttacgctgtgtctcacgtacccctgcattagttgtcatcaccagaataacattgcggaagtcagcttttcggccattgttatctgtcagtgttccattatccatgacctgtagcagtaagttgaacacatcaggatgggctttctcaatctcatccagcaacaatactgaatgtggatgtttgataatagcatctgtcaatagaccgccctgatcgtatcccacataacctggtggtgcaccaatcaaacgactgacggtatggcgttccatatattcagacatatcaaaccgcagtaattttatattgagcattttagcaagctggagagtaacttccgtcttacccacccccgtaggccctgcaaacaggaaagaacccactggtttatgatcctgccccaacccggcacggctcatcttaatggcttccgtcagtacccctattgctttatcctgaccgaaaaccagcatcttcaaacgatcatccagtgttctcaatacatctttgtcactggctgaaaccgttttttctggaatacgggcaatacgagccactacagattcaatatcggcaacgttaatcgtctttttacgacgactggccggcatcaatcttgtcctcgcacccgcttcatcaataacgtcaatcgccttatccggcaggtggcgatctgtaatatatttcacagatagctcaactgcggcgcgaatggctttcgcagtataacgaacatcatggtgcgcctcatatttcgtacgcaacccattgataatctgcaccgtttcctcagaagaaggttcaagaatgtctatcttctggaaccggcgagccagtgcgcgatctttctcaaaaatattactgaattcgtgatacgtcgttgagccaatcacccgaatgcggccactggacaacagcggcttaatcaggttagccgcatccacctgtccccccgaagcagcacctgcaccaataatggtatggatttcgtcgataaagagaatacttttgctgtcttgctctaacgtttttaacaaagatttgaagcgcttctcaaaatcacctcgatactttgtacctgccagcaatgaaccaatatccaacgaatagattgtgcaatccttcataacctcaggaacatctttttgcacaatacgccatgcaagcccctctgcaatagcggtcttaccgacacctgactcacccacaaataaagggttgtttttacggcggcggcataatacctgaaccgttctttccaattcatgctgacgtccgacaagcggatcaatctgccctttttgtgccaattgattcagattggtagtgaaattttccagtcgatcttcacttatcacctgttcctcctgaatcggattgacactgtgatgagactcattatcagactcatctttgcgcgttccatgtgaaatgaaattcacgatatccagacggctcacatcatgctttcgcagtaaataagcagcctgggattcctgttcactgaaaatagcaaccaagacattcgacccagaaacttctgaacgccctgaagactgaacatgaaacactgcacgctgtaatacacgttgaaaactcaacgtaggttgtgtatccctgtcatcattctctgataacaaaggggttgtttgtgcgataaaattttccaattcctggcgtaacatcaccagatcgactttgcaagcctccagtgcttctcgcgctgatgtattgcttaacaacgccagcaataggtgctctacagtcataaattcatgtctgttatcccttgctttggcaaaagcaatgttgagactaagctccagttcttgattgagcataagcacctcctcctaaaatcagtaagccagatcagaccttctccagcgagcaaagtaacggatgctcgtgctctttagcatacatattcacttgcgcagctttagtttctgccacctctgccgtataaatcccacaaattgccttaccttggtaatggatatccagcatgagttgcgttgctcgttcaacatcataagaaaagaactttcgcaatacgtcaaccacaaactccataggggtatagtcgtcattgttaagaatcaccttatacattgatggtggctgtaacgtttgctctgttttatcttcaattaattcttcaattttcaaactgttataaaactcactcattgttcttccgctgggtattaactttctgctggattttagtatgaactaattcattctactgctatatattttatcacttcatgaagcactctgcttatcccctctttgatctctggataaagatcccgcctaaaaatcggatatcgttatctatatcaaactttcgctatttgagacagcttgaggttatttctgtgcttgacggcgtaatgaatttcactacagtatattttgtgagcaccgccttggctgggcgtctgctcatatcctaaaatttttagtgactcctaaatccgaaatcgtgatatgagggataaagaagtatggaaacaggtactgtgaaatggttcaataatgcaaagggctttggatttatttgtccagccagcggaggcgatgacatattcgctcactattcaaccattcagatggatggttataggacgctgaaagctgggcaaaaagtgaacttcagtattcatcaaggccccaaaggcaaccatgccagccttattgttcctctggaagatgactcgaaatcaaaaaaagagtgaccagataaattcgtaattcccacgccacaaatgaataatggcttatttgtggcgtgctattaatacaagttcatttagcactggcccttctactgcaattctcaactgacacgtaaataaatacgtttaagggcttgctccgaccccacccataatggacataaatgacgaaaacgtgtcgtacgatggcgaccaacccgtgataatcgattaacaccgctaaaaccggaaatttctacacgttccaggaacatatactctcctttttcgcatcagatttgcttaatttttttatgatgcccaattccttagacagtgcgaaacgcgttgaatttcagtatgtttccctttattctatttattattttagtgtaaaaatattgttgtcatgattttattagtctttatgactggttcaagttatagagccagataaaaagacgtttattcttgaataaggatatgggttatgtattcagggttgctaattgttctcatgccattaattctaggctaccttattcgtctgaataataaaacggcgctggccacagttcattacctacttaatatcatgatttatgtcattctcttcctgatgggcgtcagcctcgccatgctggagaatctgggcaataatctactctctatcctgctgtatgcgatgacatttttcttgtgcatatttgcgactaacttgctggcacttctcctattggataaacgggatccttggattattcaagtcaataaacaggaaaaatcaccttctcaattacatatggcttttgattccatcaagttatgtagtgcattgatattaggattcttactcgggctgacagactggtcattgtttcattttgccagtcgtgccagtgaaattgccttgattcttttactgcttctggttggtattcaactgcgcaataacggaatgagtttaaaacaaacgctgttgaatcgccgtggcaccattatcgctctgatcgtcgctataagttccctgttgggcggcatgatagccgcatttttactggggttaccgaccaaaaccggtcttgccatcgcatctgggtatggctggtactctctttctggtattttactctctgacgcttatgggccggtgattggcagcactgcatttttcaatgatctagcccgtgagttggcatcaattctactcatcccgatgctcatcaatcgttatcgttcaacagctttggggttaactggagctgcatcaatagacttcacattgccaatattacaacgctgtggtggcataagtatcgtaccagcagccattgttcacggttttatattaagcttgatgacacccgtatttattgcattttttactcaacaggcttaggcgttacctgatgcatgaaaaggctaaaaagcaaacttatttggtatgaaaatcaatccatttagccaaaaatagaacataaaataatctaaaaaaggctgatagtctgattagttaagtcactaatttgatgataataacaattttatgcagatattattgcatagttattcttatgagattaatatccctccaatctattaactattcatatttatcgcatgagcattcaattaaaaaacataaattgtttctatggaacgcatcaggccctgttcgatatcaattttgaatgtacatcaggagaaactgtggtgctgttgggcccgagtggtgctggcaaaagctctttactgcgagtgcttaatctattggagatgcctcgttctgggcaactaagcgtggcaacacatcagtttgatttcaaacagcagcccggcgccaaggaaatccgaacactgcggcaaaaagttggcatggtttttcaacaatacaacctatggccacacctaactgtgatggataacttgattgaagcgccctgccgcgtattaggtctatccagacagcaggctcgggaaaaagcagcaaaactgctggcccgtcttcgtctggatgaattttccaaccgtttcccacagcacctgtctggcggacagcaacagcgtgtcgctattgcacgggcattaatgatggaaccccagattctgctgtttgatgaaccaaccgctgcacttgatcctgaaattacatctcaagtcatcaatatcatcaaagaactggcaggaactggtattacccaaattatcgtgacacacgaagtggaacttgcgcgtaaggcagcaactcacattgtgtatatggagaaaggccgcatcattgaaaaaggtgacgcaagtcattttttaaaacccaaaacagaagcctttgctcattatttgtcacactagctctgtcatactaaatctgtcatacaaatagtcagttagaacataaaacaagcatcagtaacatttatcaaccataatgctcatgaactccaggatatgactatgaagaaattattgtttgctgccttattaaccgcaatgactttatccgcatctgcaaccgcagcagaaaaagaaacgctgcgctttgctactgaagcaacctatcctccatttgaatttattgatgcaaacaataaaattcaaggattcgatgtagatttggcgaatgctatttgcgcgaaaatcaacgcagagtgcacattcaccaatcaagctttcgatagcctcattcccagcctgaaattccgccgttttgatgcattgatggcaggcattgatattacgcccgaccgccgtaaacaagttgatttcactcatacctattatgataactctgccgttttcattgccatcaaagggaagttcactcattctgccgatctgaaaagcaagcaagtgggaatacagaatggtacgacacatcagaaatatttgatggaacagcataaagagatcaaaaccgtaccttatgacagttatcagaatgcaatccttgatctgaaaaatggccgtattgatgctgtattcggtgatactgccgtcgccaatgaatggctgaagaagaataaagaattaggctctgtcggcgacaaagttactgacaaaaattactttggcattggtttaggaattgcagttcgtaaaggtaatacagctttgctggataaactgaacaaagcactggctgaagtcaaacaagatggtacttataactccatctataaaaaatggtttgaacaataacagaatcctaatgaatgaacttcaatctttaattaacgccgccggtattaccgtcggccttgctgtttcttctcttgtcattggcttaattctggcaatgctttttgccgcttgggagtcagcccgctggaaaccctttgcttttttaggctcttgttgggtcacattgatcaggggattgcctgaaattctggttgtcctcttcatctatttcggaagttcacagcttctcataacgctgtcagaaggctttgatgtcaatctcattgtttggcaattcagaatccagatggaaattgacaactttgatgtcagccctttcctttgtggtgttatcgccctttctctactttactccgcatatgcatcacaaacactgcgaggcgcattgaaagccgtcccaatggggcaacgggaagccggacaagcacttgggttaagtcaaagccgtatattttttcgtctgaccgtgccgcagatgtggcgccatgcattgccagggcttggcaatcagtggttggttctactgaaagatactgctttagtttcactgatcagtgttaatgatctgatgttgcaaacgaaaagtatcgcgactcgcacacaggaaccatttacatggtatgtgattgccgccatgatctatctggtgattaccctggtgagccaatttattctcaaacggcttgaaatgcgcgccactcattttgaacggagtgcttccgatgtttgagtatataaaggatatcttacctgggctgcaaactagcctaagcttgactgtcaccgcattactggctgcatttatactgtctgtggttctgaccttcattttaacgatgaagttgccgatactatcccaattggtaaaaggctatatcacattatttaccggaacgccgttactggttcagttcttcttgatttactacgggcccggacaatttccctcaataaaagagtacccttggttatggcagctcatgtcagagccgtggctatgtgccatggtgacactggccttgaacagtgcagcctattcaacccaacttttttatggcgccgttagggcaatccctgctgggcaatggcaatcctgtcaggctcttggtatgtcaaaaacccattccatgcgcattctactgccttatgccttcaaacgagcgctttcttcctattccaatgaagtcgtcttgattttcaagagtacctctctggccagtacgatcacacttctggatatcatgggatatagccaacttcaattcgggcgtagttatgatgtgactgtatttgttgctgctgggatcatttatctttgcgtaaatgctcttctgacactactgatgcgcatgattgagcgtcgagccttatcatttgagcaacgttattaaacactcaatggcacaccatttatctgctttttgcttctgtcagcgataactaatagttatcgctgacagaaatacaactaaatcccctgttactttccatcaaaaatcaataacaccagcgtttcataatgttctgtatgagggaacatatcgaataattgcactttttctattcgatattgctcaagcgcagcaatatcttttgccattgtttcggcattacaacttgaatagagaataaatttaggtgccatccggctgaggtattcgcataacgccttaccaattcccctgcgaggaggattcaccagcaccagttcagggagttgcgctttatcaagggcaaaatgtgtagaatccaatgcctgaaattcaacctgctcaagaccaagacttttggccgagtttttggcacaggcaatggcctctgcactaatctcaatccctgtcagtctggtttctttgtctgcacagtgcagcccaaaacctcctgctccacaaaagagatcccacatgctgctgctattcagctctctgacccaacgaccagccgtcgcataaagcgccgaagcaatttctgggtttgtctggaaaaaactacggggacgaatatacagcggaattccgttgaaggtttccttcagcattttatgttcagtaaaaatgatctctttttcaccttccaaaatcgccatatgagttggttgaatattggcagaaataaccgccaattgtggtagttgttcctgtaaccacggcaaagcatgttccaactgagccagttttatttctgagcgcaggacaaaacgtagcatcatttcaccgctggcacggctttctgtcagcagaatatatttcaattccccttttttacgtgcaacgttgtacggaaccaacccggatttagcgataaatatttttattgcttcaaatactggctgaaaatattgcggatacaaagggcaatcacaaagatccaccgttctgccatcacggtgaagcattccaagctgtgggcgttcaacactgccacttaccaccatcttggccttattacgaaacccactgatcaggctgctgactggaggcagccagtacgttgctgacgtctcccgtaaaagctgctgtaaatgttgttgtttatcagataattgttgtgaataggacttattgagccactggcaggagtgacaatgccccgcggtatactgcgcacattgcattgtaaaaaaccatatcaaagaatattagtgcaaggtaaatgtcgatgtttccgtcgaagccaatgattcctcatcttctacttctacttccatctcgctttccatatcattattaatataaaggaagttattgctgtgaatttcaaaaatcacattggcaatctgctcctcactttgctgcaagaaatgggaaaactgcgggaaagtcataccagcggcgataggaaatgcctgacaaactatcaacttcggtaagttttcgtcctgaatatcaaggaacgctttggcagtgagggaactcgcattaatctggctcaagtttgcaactaatggaattatcgccgttggcctgacttctgccagagcagaaaacagcactacgtcacccaacagatcaatcttggcatcaaacaggccatcaatgttctgcatatgaggcaaatgcaagaccgaatttgaatcattctcaaaataagaaattttgaggcgttcaagccagttacgcaatgttgccaaatttggaacaaccatagaatccatcgaatcaacctcatatgaccaaaaagttgtacatgctacctgaaggaaacaccttgccaatagcagcacgatcaataattaacctattttgttttttcatcatcagaaccagtctgatgatttttatctactttcttatgatcaattcccaaaaaagaaagattatagactgcatgccagataatatggatagctgcaggtatcaagcaacctatacccaataagatcatagcaatgtgcgcttctgtcgtcattaataaaggtgatagaattatgctatcagttatcgacaaatacgccaaaaccaacaagccgattcccaatatttctaataaaataaccagctttggcatatctgacaacgagcgcatctcttttgttgagattttcttcatgactctctaccttctgagcctgacaaattagactctccgcctcttatagagggactatcatacctgaatcccttctatcggcaggacaaattagaacaaaaggcaattcctgcttttttttgccaacgcttacaggcatagtaaccccagatgacaatctataaagttcacgattattaccactaaggagtttgtatgtatactgtcatttttggtcgcccaagttgcccatattgcgttcgcgccaaagaattggctgaaaaattgaaagcagagcgcgacgactttgattaccgctatattgatatctgggctgaaggcatcaccaaagacgacttgtcaaaaactgtggggaaacccgttgaaaccgttcctcagattttccttgatgagaaacatatcggcggctttactgattttgaagcttacgctaaagaacatctgaacctgtacaaataaccataaaactcactatccagccagaaatgtcgatgctttcttctggatagtggcaggttcataatgttgactaagatccacatatccactgaattgaaaaaaatctgtaatttttttctcaacaatgagaactttcatcacatcacgcagtctgaattaatgccactgcttttctttgatgtccccatattgaggagcccgatagtcacccattttggttaaaggctatcgggtttttttatttgtcactgcgttatccacagcacagagggcatcgaaatcatcttttcttgctatcatcggcatattgtttactcacttaacatcaacaatcgttaaataacatggtgaattaaagcaaaaatcctttactgaatcgtattataaaattactatttttaacaatgacttgataaagcatgtttatcatatttgcgtcaatatcacgcttgtgaggcttactttgctagaacaacttaaccacaatgtgtttacttttatcaatgcaacaccggattcatcaccagcaatgattttactggcgatctttatagcaaaatatcttgtgtttattttccccataacattagctgcttgctggctttggggagaaggaaaagccatctcacatcaacgtattgttgtcagtaaatcctgtattgcctttgcctttgcaatagccggttcggatatcatcggaacatttgttccacacgcccggccgtttgtagaaggttttggttacaattttctctatcattcccctacagcctcttttcccagtaaccacggtacagcagtctttaccttcgcgttagcatttatcttctggcatcgtatccggtcaggtttatgcctgatgatcatcgcctgcatgattgcatgggccagaatctacgtaggagttcattggccaatcgatatgatcggcgcatttctagtcagcttgatgggttgtgctttttcacaaatattctggcgcttatatggtgagtattggcacagtaaactcattcgcctttaccaattctgctgtgcatttttcatccggaaaggatggataaaaaattaacccaacggcaatatgccactggatatttatgctacaaataaactgctgttgaatatttgagctttatttttgaagccttaaattcaggtaaatctaccttaagcctcattatcacggctagtttaaggctttattttacccaaaccatttattaacattttatttacaaggtgcgggcaaattaatcgacagcataaaatgcttcattatatttaacaatatatagcgataatatgattactgtttcttcataaatcaaaatttgactgacaatttttttgcactacgattgtttaaatcaaaaaatttattaatacataatcaataaaagcaaagatgtaaacacagagaacaaatattcaccagaaactcaacgattaaatgttttctttttatttcaataagataatattagcttgggttaattttattatatttaaaaaatcaaaatttatatttataatactattttagactaaaaaatatttacacatttaatatcattaatatatgaataccagtatggttttgtgaatagaacacaaaaatttaaaattaaaataatcaggttcacttccttgatttttctttttcattttatgtaatatttaattaacactttcataaaaccttataacatattaatttttagatataaaccttgcaattgcgagagtgatcacggtacatttcactgaaaataactatattttccctatcaaaagactagggttaaattttttgatttcaacatcaaaaataaagtacagcaggatttcaactcttctgctttagctgaccacattttggtcagtttattaatgtagtaaaaaaaacgtttagatagacgtcagaacaatatctaacaacttattattcatataaatagaatccaactcgtgcattttattaatgtgcaggtttagcaatttttaaattttactttactgcgttatttcggagatatttatggacacgtctcaatcaggttctatcgcagcctctgctgcttccggcaaaagcgattatactacctggcgtaaatcagacactgtatggatgttggggttatatggcactgccattggcgctggagttctgtttcttcccataaacgccggtattggtggtttaattccacttatcatcatgacactactcgcacttccgatgacattttttgctcaccgtggaatgtgccgttttgtcttgtctggcaaaaagcatggcgaagatatcaccggcgtggtagaagagcattttggtaaagttgcaggtttcctgatcacaattctctacttctttgcaatttatcctattttactggtttatagtgttgcactgactaacaccgtagacagctttattactcaccagttacatatgaccgcaccaccgcgtgcattgctggcactggtactgatccttggtgtgatgagcattattcgcttcggtgagcaatttatcgtcaaagcaatgagcgtactggtattcccattcgtcgccgttctgatgctgctggcactgtatttgatcccacactggaataccacaatcttcgataccctgtcactggaaaatgtcctgacttccacgaacggtcatggcttgctgtttactctgtggctggctattcctgtcatggttttctccttcaaccattctccaatcatctctgcatttgccgtagcaaaacgcgaagagtacggtgaaaatgcggagaaaaaatgctcgcgcattctgggttatgctcacatcatgatggtgattaccgtcatgttttttgtcttcagttgcgtactgagcctgtcaccggcaaacctggcagaagcaaaagcacagaacattactatcctgtcctatctggctaaccattttagtgcaccaactattgagtacattgctcccttaattgccttcattgcaattactaaatcgttcctcggtcactatctgggtgctcgcgaaggcttcaacggtatcgtaaacaaagctctaagcacacaaggcaaaacgattcagcgtaagtcgctgaatcgtatcactagcctctttatgttagtcagcgcctggatcgtggctactcttaacccgagcattctagacatcatccaatccctgggtgggccaatcattgccatgattttgttcatcatgccaatgtacgctattcacaaagtgccagctatgcgcaaatatgctggtaagccaagcaatgtctttgtggttgtgacaggattaattgctatttctgcggcagtttactcagtcatgtaatcaaagctcaagcgctgatttctacgacagcagctccataaaaatgccggccgacttcacgattgactggcattttcctatttatccgaagctcatacatcttcaatatttctggctatttcgtttatcttcctacccgaaaattgagttaaaccagccgctgacagtcttcacaattaaatcccaaatacgcccaaaaaagccactctcttctacagcttctttaacaaccaacggacgttgatcaatcaccttatcattcagcgaaaaattcacagttcccacaacttgattcttcgccaatggcgcttcaagtgaagtttggttcagcgtaaaactggctttcagattattcgcttgacctcgcggcaccgtcacggccgtatctttttctacacctaaagccacctctgaacgcgtaccgaaccatactctttctgtcaccagtgtgtcactggctttaagcggagtactggcttcatagaaacggaatccccatgacaggatcttttcactgtcagagaaacgcattcgatcactaggcgctcccagtacaactgaaatcaaacgcattggcccttccgctgcagaagcaacaaggttatatcctgccccgttggtgtgtccggtttttacaccatccacattcatattctgattccacaataagcgattgcggttaggttgacggatattattgaaagtaaattctttctctttattcagcgcatattcttctggcacatcacggatcatagcctgactcaagagcgccatatcacgagcggtactgtattgccccgcagcatccagaccgtgaacagtcttgaaatgggtattttccagtcccagagttttcgagtatttattcatcaaatcaacgaaagcatcctgactgcccgctacataatccgcaagggcaatactggcatcgttgccagattggatcacaatgccacggttcaaatcaatgactttgacccgatcacccggtttcaaaaacatcagggatgaccctttaagcgccggattgccggttgcccaagcatctttacctacggttacctgatcttctgtggaaatctttcccgacttaatcgactgaccaacaacatagctggtcatcacctttgtcagactcgctggatctagccgctcatcgggattatgggatgccagaatttttccactggcgtaatccatcaatatataggatttcgcatcaatttcaggtgctgagggttcatccattgcgtatgcgttgacacccatcaaccaaaaaacacccaagccaacagtaaaagatttgattatctgtacctgccgtctttttttcatcatagcccgccctttttgtctacaaccagaatataaaagctctattaatataggatgttatgagacaagactccaacccaataacgtaaagattttcttgttacccgaatgaatttattgtcatattatcgatgactcaaaataacctgatattaaggaaagaatgatgttgacaatctggggccgtaaaagctcatcaaacgtaaaaaaagtcatttggtgtctggaagagttaaacgtaccatatcagcaaattgatgttggtggtcagtttggcaaacttaatactccagaatacctgctcatgaatcccaatgctgtcattccttgtttgcaggaagatgattttatcttatgggaatcaaacgcgattgtgcgctatatttcggcaaaattcggcgagaatagtctttatcctgccgatcttcaagaaagagccagaattgatcaatggatggattgggtaggctacaatctcttcccgccgatcaaacaacttatgatcaacattgtcagaacaccggaagatcagcgtgacccgaaagtggttgcccagatattaaaagagatagaaaaactgctgaaaattgtcgataacgtactaggtaagcaaaaatacctttccggtgataagtttggcatggcggatatcgccctcgctccattggtctatccatggctaaaggtcgggatagagcgtccatctctgccaaacttggaacgctggtatcaattactgaccgaaagaccagcgtttcaaaaaatcgttatgattgaaataagctgatcatcagctcattggcattctgccgggatctgggaattgatactcaaaccccagttcccgacagatacggctaccgtcaacaactttgctcgcggctccctgagcctttgactgtgaaaactctggcggagccaaatcgagctgactactagcctgcgaataaaactcctttcttttcggatgttctggcgcacacagattatagatatgccctcctttctgctgctctataaggcgtttaatagcagaaataacatcatcctgatgaactagattgaccaccttttctccaccctcaatcgctttccgccctgcgaggaaacgccctgcatggcgaccactgccgaccaaaccagccaaacgcactatatcaacagaagtatttggcagtcgatgcagccagttttccaattcaaccaacgccttggcagatcgcgtctcaggaaataatggagcatcttcattcagatgaccgacagacgagccataaactgaagttgagctggtgaaaataatatggggaaccgaatgcgaaagcgcagtatcgacaactaactgcaccgctttgacatacccttccccaccccccgcaataccgctaacaggtaatgttagcactagtacatccactgacatgagccgttcaagatcatccgtttcacagattatctgaggggtcagattcaataagtggcaatctacaccacacatgcgtgccgcttcgacaccatccgctgttgttttactaccgaccacttgcataccatagccttgcaaaatttgcgctaacggcattcccagccaacccaatccgatgatggaaacttttttcaccataactctcctcaggaccgatatgattttgattcttcaggctatctgcatattgccttaacgacaacaccagttttatttataaaacaaacaattagaacaatacaaacagctcctttgaaaaaaaagttgcttttcatacacaaaatcatataggttaaacggtaagcaaccaatccttgttcgcaaacatatattaaaaaaagtagatagagagctcacatattatgaaccgtattcaatttagccatcatcaccatcatcctgactagtctttcaggctgttgtgtgctggaagacatttagtaagtcttccggtggcatgagtacgataaaaaaccctcggaagattttccgggggttttttattgccaatttacgcgatttatatattgaatattgagatagggtaaaacataacatgctagataaaacacgcttacgaatagccatgcagaaatccggccgcctcagtgatgattcccgggcattactggctcgctgtggcatcaaaatcaacttgcagcaacaacgtctaattgcatttgcagaaaatatgcccatcgacatcctgcgtgtccgtgatgatgatattccgggtcttgttatggatggtgttgtcgatttaggcattatcggtgaaaacgtacttgaagaagaactgttaaaccgtcgggcacaaggagaagatccccgttataacacattgcgccgccttgattttggtgattgccgtctttcccttgccgctccctttgactacgactataccggagtggaatgcctgcaaaattcccgtatcgccacgtcttacccctacttactgaaacgttatttggataaaaaaggtatccgtttcaaatcctgccttctcaacggttcagttgaagttgctccccgtgcaggattagctgatgctatctgtgatttggtttcaacaggtgcaacactagaagccaacggcctgcgggaagttgaagtcatctatcgctcaaaagcctgcctgatccaacgcgatggtgagatgccagaagccaaacaacaactcatcgacaagctgatgatccgaatccaaggcgttattcaggcgcgtgaatccaaatatatcatgctacatgccccaaacgacaaactggaagagattatctcgttacttccgggtgctgaacgtcccaccattttgccactagcgggggcacaaaaccgtgtagccatgcatatggtcagcagtgaaaccctattctgggaaacgatggaaaaacttaaatcactgggctccagttccattttggttctaccgattgaaaaaatgatggagtaatcttgatgagcacccattttaaaaccattatccgctggcaggaatgcccaccagaacagcaaaaagtattgctgacacgtcccgctgtcgccgcttcagaagatatttctcgcacggtaaaacagattctggaaacggttaaagccaacggcgatgaagcattgcgggaattcagccagcgcttcgacaaaacaacaatcgatactatcccgatttctataagtgaagttaacgcagccgccagtcgtctggcaccagaaatcaaacaggctatgcagcaggccatgaataatattcgcctgttccatgaagcccaaaaacctgctgtgattgaggttgaaaccctgccgggtgttcactgccagcaagtcacacgcccaatcgattcagtggggttatatattcccggtggttctgcgcctctgctttccactgtattaatgctgggaacacccgctagcatcgcaaagtgccgtaaggttattctctgctctccacccccgattgctgatgaaattctctacgcggcacagctctgtgggattaacgaaatatttcaggttggcggcgcacaagccattgctgcaatggcctttggcacagaatccgtccctaaagtggacaagatttttggcccgggtaatgcttgggtaacagaggctaaacggcaagtgagtcagcgcttcgacggtgcagccatagatatgccagcaggtccatcagaagtgctggtaatagcagacagtggagccaatcccgcatttacggcagcagatctgctttcacaagcggaacatggccctgattctcaagtcgtgctggtcacacctgacgaaacttttgccgagcaggtgatccgggaaatcgaaacccaacttgctgccctgccacgccaacaaatcgcggttcaggctctgcaatccagccgaatcattgtcactgacgatctgactcaatgcgtagcgataagcaatcaatacggccctgaacacttgatcattcaaacccgccagcctgagcaacttgtggagcaaatcaccaacgcgggttcgatttttctcggggattggtcgccagaatccgcaggagactacgcttcgggtaccaatcacgtcttaccgacttatggttatacttcaacctattccagcctcagcctggcagatttcctgaaacgaatgacggttcagcaaattacacctcaaggattgagaaacctcgccccaaccatagaaacactggcgcaggcagaacaactcaccgcgcacaaaaatgccgtcacattacgcatagctgccctgaataactcagatgttgaataaccaagataaggagcaatgatgagtactgtttttgatgtcaattcactggcaagagaaaatgtccgccagttagtcccttatatgtctgcccgccgtctgggtggcaatggtaatatctggttaaatgccaatgaatatcccatcgcccctgattttcagttcagcgaaaaaacgctcaaccgctaccctgaatgtcaacccgtctctgttatccagcgctatgcggattatgccggcctgcaaccggatcaagtccttgtcagccgtggcgccgacgaatctattgaactattgatccgagttttctgtgaaccgggaaaagacgccgtgctgttctgccctcccacttacggcatgtacagcgtcagtgcagaagcctttggcgtagaacagaaaaagatctccacccgtgctgactggcagccggacattgccgctatcgaaaataatctggatcgcgtgaaactgatttatatctgtagccccaacaaccccacgggtaatctgattgctcctgcggcactgcgacagatccttgaactcgctcgtaaccgtgccattgttgccattgatgaagcctatatcgaattctgtccgcaacatactaccaccggctggctgcaagactatccgcacttggtgattttgcgaaccctctcgaaagcttttgcactggcaggactacgctgtggatttacactggcttctcccgatattatcgcgctaatgttgaaagtgattgctccatatccacttgccacgcctgtagcggatatagctgcgcaggcgctgacagaagcaggcattaatataatgaaagatcgtgtagaggaagtggctgagaaccggacttatctccggcaggcattgaatgaactggcaatggtcgaaaaagtgtttccgagcgaaaccaactatattttagtgaaatttaccgatgcggaaatcgtattcaggacattatgggagcaagggatcatcttgcgtgatcagcggaaacaagcgggattggataattgcctgcgcatcaccattggtagccgaaatgagtgtgaacagttggtcaatgccatcgctgctcttcgtagccagactcaaccactaaaggaaactgaaaatccatgagccagaaactgctttttattgaccgcgatggaacgttgatcaccgaacctccgaccgattatcaagtcgatcgccttgataaattggcctttgaagctggcgtgatccctgccctgttatccctgcaaaaagcgggttacaaactggtcatgatcaccaatcaggatggattgggtactgatagctttccccaagccgattttgagccaccacacgcactgatgatgcaagttttcacttcacaaggcattcagtttgaagaagttctgatctgcccccacaaacccgaagacaattgcaactgccgcaaacccaagctcggattggtggaaaaatatctaacagaaggcatggtagatacgaaaaacagttgcgttatcggggatcgggaaaccgacttacaattggctgaaaacatgggaattaaaggaattcgctatcaagcccaatcacttggttggtcagcgatttgtgagcaactgacccgcaaagatcgtcatgccagcgttgaacgtaaaaccagagaaactggcatcaatatcgatatctggctggatcgcgaaggtagaagcgaaatcaatactggcgtgggtttctttgatcatatgctggatcagattgccactcacggcggtttccgcatgaatgtacaagttaagggcgatctctgtattgatgatcaccacaccgttgaagatactggattggctttaggtgaagctctgaagcaggcattgggcgataaacgcggcattgcccgttttggcttcacattaccgatggatgaatgtctcgcccgctgtgctctggatatttccggtcggccacatctcgaatacaaagcagagtttaaacatcagcgtgttggcgatttaagtactgagatgatcgaacactttttccgttcactctcttatacgatgggatgcaccttacacctgaaaaccaaaggtaagaatgatcaccatcgggcagaaagtctgttcaaagtctttggccggacattgcggcaggccattcgcgtagaaggcgatgttctgcccagttctaaaggcgtgttataagggatgtcatgatgaaagttgttattttggatacaggctgtgccaatcttgcctccgttacttatgccatccgtcgattaggttatgatcccgtcgtcagtctggatgcagatattgtgcgatcagccgataaactgtttctgccgggagtaggtacagcaatggccgcaatggatcaactccagcaacgacagctgatcccactgattagctcactcacccaacccgtactgggtatttgcctcggtatgcagcttctggcggcaaccagtgaagaaagcaatagtgaaaaagacgataacgtctccttactggcattaattgatgcccccgtcaaaaaaatggcgactgctggcctgccattaccccacatgggttggaatcaagtaaaagcacagactgggcatcccctgttttgccatattgaagacaatgcccgtttttattttgtccatagttacgcgctgcctgttggtgaatacaccattgcccagacggaatatggcaattccttcagcagtgccattgcaaaagacaatttctttggtgtgcagtttcaccctgaacgctctggcacagcaggcgcacaactgctgaaaaactttttggagatgtaaacgtatgattatcgccgcattagatttaattgatggcaacgtggtgcgtttgcatcagggggattacgaccagcagcggacttatggcaattcacctttgtcccacctacaacaatatgaaaaagaaggcgccaagttgctgcatctcgtggatctcacaggcgcaaaagatcccaccaggcgccagatgatcttgctgcgtgaattgctggatgacgtttctgttccagtgcaagtgggtggtggcatccgttcggaaaacgatatcaaatcactccttgaggccggagctagtcgggtagtcattggctcaacagcgatcacacagccggaattagtcaaacaatggtttcagcgatatggtgcagagtcaattgtactggcactcgatatccgcatcagtacagacggtgctaaacaaattgccatcagtggctggcaggaaaacagtaataccactcttgaacaggttattgagcaatatctccctgttggtttgaaacatgttttatgtaccgatatttcccgtgacggcacactaaacggctctaatatcgcactctatcaggaaatcagtcagcactacccacagattcaatttcaggcatcgggcgggatcggcaaccttgctgatatttctctcctaccgacgactggcgttgcgggcgttatcgtcggacgggcattacttgaaggaaaattcacactgacggaggctatccaatgttggcaaaacgcataattccttgccttgatgttcgtgatgggcaagtggtcaagggagtacaattccgaaaccacgaaatcatcggtgatatcgttccacttgcacagcgctatgcccaagagggagctgatgagctcgttttttacgacatcaccgcttcttcagatggtcgtgtggtagataaaagctgggtggcgaaagtcgctgaagtgattgatattccattctgcgtcgcaggcggcatcaaaactaccaaagaagctggccagattttatcattcggtgccgataaaatttctattaactcccctgctctggctgatccttcgttaatcagtcgtctggccgatcgctatggcgttcaatgtgtagtaatcggtatcgatacgtggtttgatgaaaatagcaacagctatagtgtctatcaatttaccggtgatgaaaaacgcacaactgcaacgcaatggcaaacactggattgggtcaaggaagtacaacaacgtggcgcgggtgaaatcgtcctgaacatgatgaatcaggatggtgtccgcaatggctatgatcttacccaactgaaattggttcgggatatctgctccgtacctttggtggcttccggcggtgctggtacgccagaacattttttggatgcatttaaactggctaatgttgacggtgccttggctgcctccgtctttcacaaacagatcatcaatattggtgagctcaagcaatatcttgctacacagggtgtcgaggttagaacatgttaacagcacagcaaatcgaaaaactggattggaaaaaagtggatgatctcatgcccgtcatcgtccagcacgctgtatccggtacggtgttaatgatgggttacatgaatcaagaggcacttaatgccacacaggaatccggtaaaatcacctttttttcccgcaccaaacagcggttatggacaaaaggcgaaagttccggccacttcctgaatctggttgatatctaccccgattgtgacaacgataccctgctcgctctcgtcaatccgattggcccaacctgccatacaggaaccgagagctgttttgcaccagcgcaaactgaatggggcttcctctaccaactcgaacaactactggcaagccggaaaaatgccccaccggctagctcttatactgcccgtctgtatgccagcggcacaaagcggattgcccaaaaggtcggtgaggaaggcatagaaaccgcactggcagccacagttaatgatcgggaagaactgaccagcgaagctgctgatttgatttaccacctgctggttttattacaagatcaagatttggatctcagttgtatcatccgccaattgcaggaaaggcatgtagctaaagaataatttgcttagcaggaattgaggtttcaataaattgcagtcatttcgcctacggaggcgattcataaaataggtagagtcgaaatgtggcgcggtaattgtaagttcggcatatctggtgccacctcgcttctttttgaatcttgccatagaaatggcaagatttatcgagttacattgccgctttaaaaatagccacaatctcttcgtgtgatgcctgaatcgggttggtaaaaccacaagcatcttttaacgcattagttgccaacgttggcaagtcttcaactttgacacttaactcggacaaccccgccggaatattgacatcttttgccaatttgctgatttcttggatacagacttctgcaccctgccgatcgttcaagttggcaatatcagcccccattgccgcagcaatctctttcaggcgagatgcagatacttttgcattgaatttttgtacatgtggcagcaatactgcattgcaaacaccatgtggcaaatcataaaaaccacctaactgatgcgccatggcatgaacgtaacccaaagaggcattattgaatgccatacctgccaaaaactgtgcataagccatattctcacgcgcttccatatcattgccattcgcaacggcacggcgcaaatagtcgctaatcatcgtcactgccttcaacgcacaggcatcagtgataggattggctgccgtagaaacataagcttcaatagcatgagtcagcgcatccatgccggttgcggcagtgagtcctttcggcataccggccatcaatgcggaatcattgattgacaatataggcgtcacatttttatccacaatagccattttgatatgacgatcaacatctgtaatgatacagaaacgcgtcatttcagaggcggtacccgccgtagtgttaatggcaatcaatggcaattgaggtttagcagaacgatcaacgccttcgtagtcacggatatccccaccgttagccgccaccagcgcgatcccttttgcacagtcatgcggtgaaccacctcccagagaaataacgcaatcacaatcatgctgacgcaggatgattagcccctcttcaacattaatagtggtcggatttggattcgtcccagcataaatcgcactctttatccctgcttcagccagtaaactctgaacttctccaacaacaccaatctcgtttaacacgcggtcagtgacaatcaaagcctgcctgtagccataatttttcattaattcaacggcttcagtcatgcatcccataccgattttattcactggcgggataaagaaagttgatactgccattcggaactccttaggttttactgaagtatttcaaatctcgatgcaaaagaagtgggttacaatgtgacacttatctacctcagcaattttgatcgatatcaataatcgcctttgtaaaatttaaaaataggtatagcgatgcctgaactagcgacattcatcaaaattgaatagcaaataatatctccattaatgaaattaatagtgtactataatgtcaataagttcatatggcgattattatatgaataatattcctacattgataatagttgtatttttgattatcagctttgtgctaattgttggcctcgattcagaggtagcacactttattgaaaaatttgctgaaaggctgatacaaaaaaattgatatggcgcgggaagaaagtttaggagttttgtcaaaagtatgctttggataatcgaataatttatcgcatattttattaagggtgctgaacttccagcaccctatttactaacagtcgatttttaatctaaccattcagtatggaaaataccttctttatcagtccgcttataggtatgcgcaccgaaataatcgcgttgagcctgaatcaggttggcaggcaaaaccgctgaacgatagctgtcgtaatatgaaatggccgcagagaatgttggcgttggaatgccattctggacaccataagaaacgacatcgcgcagagcttgctggtactcatccgcgacttgcttgaagtaaggcgctaacaacaggttggcgatagcggagttctcattgtacgcatccgtaattttttgcaggaactgcgcacgaatgatacaacctgcacggaagatcttggcaatttcgccataattcagatcccagttgtattcatctgaagacgctttcaattgctggaagccttgagcgtaagaaacgattttacccaagtacagagcacggcgaactttctcaataaattctgccttgtcaccattgaatggctgggcttctggccctgacagaactttagaggcagcaacacgctgatctttcagagaggaaatataacgagcaaatacggattcggtaatcagcgttactggaacacccagatccagagaactctggctggtccatttacccgtacctttattggcagcttcatccagaatgacatcaaccagatatttaccttcttcatctttcttacggaagatatcagcggtaatttcgatcaaatagctgctcagttcaccttggttccagtcactgaacacatccgccagttcctgattactcagattcaaggagtgcttcagcagagaatatgcttctgcaatcagttgcatgtcgccatattcaataccattgtgaaccatcttcacataatgacctgctccgtctgcaccgatataagtgacacaaggctcaccatcaactttggcagcgatctctttcagaataggcgcaaccagctcataagcttctttctgaccgccaggcatgattgaaggacctttcaatgcgccttcttccccaccggaaacacctgtaccaataaaattaaaaccctgagcagacagctcacggttgcggcgaatagtatcctgaaaataggtattgccaccatcgatcagaatgtcacctttatccaaatgcggcgtcagtgatgcaatggttttatccgtagcttcacctgccttgaccatcaacagaatacgacgtggcttttccagtgagttaacaaactcttcaatggaataacttggaactaattttttccctggattttcagcaataacttcatcagttttatcgctggagcggttgaaaatggatacagagtaaccacggctttcaatattcaacgccagattgcgccccataaccgccataccgacaacaccgatctgttgtttggacatgaaaaactcccgtctgatcatgactgctgcccaccaagatgcctaactcaacattatgtcaatcaaacaatgtcgatcacaaatgtcatatacaacaaaattacagtgggcaatttgttaatgagattacatgttaactcaggaataggcttcaggggtagttattgatgcaaccgatatcgtcatactgtttttttgctgaaaaaatttccaactgggataaatcgcctattgatatttctgataccaatccgcattattcagtaatcggcagaagccgtcacattaaaaggtaaaataaactgtatggaatggatcgctgatcctacgatatgggccggtttggccacacttatcgttttagaaattgttctcggaattgacaacttaatatttattgccattctggcagacaaacttcctgaaaaacagagagacaaagctcgcctaacaggtctgacctgtgctctggtcatgagattgctcctgttattcagtctttcttggcttatttccctgacaactccattactaactttatgggatcatcctttcagcgcccgtgatttaattatgctgatagggggaatattcttgctgttcaaggccacaatggagttaaatgagcggttggaaggtaaaatgctacataacaaccaacagcgcaaaggtgcaaacttttgggcagttgttgtgcagattatcgtcttagatgccgtcttctcgctggattctgtcattactgccgtgggtatggtcagtcacattggcaccatgatggctgctgtcatcattgccatgatcctgatgatatgggccagcaagccgctgacgaaatttgttaatgctcatccgaccattgttatcctgtgtctcagctttctgctgatgatcggtttcagtctggtggctgaaggctttggctatgtcattccaaaaggctatctctatgccgccatcggcttctcaatcatgatcgaagcgctgaaccagttttcccagttcaatcgccgtcggttcctgagtgcttcccgttccttgcgcgaaagaaccgcagaggctgtacttcacattttaaatggcaaacgtgaaaacgccgatctggacaatcacgcttccaatctgatcgcagaccatgaagatcataaagccgtctttgaaccgcaggaacgtcatatgatcgcccgtgttctcagcatggcgcaacgcacagtcagcagtatcatgacctcacgccacgatgtggtttacctcgatatccatgcaccaactggaaaattgacaacactactggaaaagcaaccgcatacacgaattgtagtaacggatgagcaagctagtgacgaaccactcggcgtagtgcatgttattgatatcctcaatcaacagctgactcataagtcatttgacttaaggaagctcgtgcaacagcctctgatcttccctgaatcactctccctgcttcaggcgctggagcagttccgtcaggcacagacgcacttcgcctttgttgttgatgaatttggttccgttgaaggtgtggtcacagtgactgacgtgatggaaaccattacaggcaacctgcctgcggggggtggagagatcgacgcccgccatgatattcaggtaacggaagagggatactggatcgccaatggatttatgccactggatgaccttgtgctctatgttccattgccattggatgaaaagcgcgagtaccagacactggccggcttgttgatggaagacctgcagcgtgttccacaacaaggtgagcagttacagatcggcgaatatctgtttgaaccgctcgaagtaatcagccaccgcatcaataaagtgaaaatcacgtccctgaaaacggaagaaaagatagaagcataatccactgcattaaacccatcactaactgacaaaaaccgacataatgtcggttttttcagctctgacaaattttattgtatcgttttaacctttatttttagataatttgtctggacagcttcgcaggtgcaattgaatgtctcatttgacattgcctgcaagatgtctctacgaacacacattcacccagtttatgacgcaggctgattaaaccagcgccataactcaaacgggtatcacaaggggatgtgtgtcgtggtaggtagttttgacactgaccattctccacgacaggaaattcacgcacaaggtgtgctatccagtgttaatgagcaggtttgatgatttactcatgggcggagaagtcaccaccgccttcatattgccccaggatcttttcagcaaaatttcctgtggctgggttagcaatacgtctatttattgttgataaaatgagggtttcatatgagtacgaaatattttgcattactaacacatgcaggcactagtaaactggaaaatgctacgacatcggggacgaaacttgagattacccatatggccgttggtgacggcggtggcagcttacccatcccaaacgtcaatcaatccaaactgattaatgaaaaacatcgcgctgaaattgatgtactgaccattgatcccaaaaaacccaaccatattatcgccgagcaggtacttcctgagggtcaaggtggctggtggatccgtgaaatcggcctgtttgacaaggatggaacgctggttgctgtcgggaactgcgcagatctctacaagcctcaattgcaagaacagaccgttagcatggcgctacccgtcagcaactcagattggccgggctgggtaaacgagctattttctggtctggcaacacgcaattatgtgagagagaaaattaaagatcatgccgaaagccgcaatcacccagatgcaacattgaaagagaagggtcttgtcactttgagtaacgcagtagatagtgacaatgaaactcatgctgcaacatcaaaagcggtgagaacaacctatgctctggcgactaaagcctatgacttggctaatgtaaccaagcctaccgacaagtgggtacctttgacccgcaaagttaatggcaaagagctgtcatcggatatcaatattaatgcagttgatgtcggtacctataacaaggctgagattgatattcaagtcaataaagcagtagaaaccgctggcagcaaagtccccttgacccgcaaagttaatggcaaagagttgtcatccgatatcaatattaatgcagttgatgtcggtacctataacaaggctgagattgatactcaagtcaataaagcagtagaaaccgctgacagcaaggttcccttgacccgcaaagtcaatggcaaagaactgaaagaagatatcgtactcagtgcggctgatctcgatacctataagaaagatgaaattgatcataaagtcggcaaagttgaagctctggctgaaactgccaataagaatgcaacctccgcaattcaaagcgctgacagtaaagtgccattaatccgcaaggtgaatggtaaagaactgttaacagacattgaactgaccgcacttgatgtaaatgcctacaacagaccggaaaccgacgagcttatcggcatagttaaaaaacaggctgatactgctaaccaaaatgcgacggctgccctccaaagtgctgacagcaaagtccccttgacccgcaaggtaaataacaaagaactgctaactgacattgatctgaacgcggcggatgtcggtacttataacaagtcggaaattgatgctcatatcaacaaagttgagcaattggctgataccgtcaataagaatgcgacttccgctattcaaaacgctgacaacaaagtgccattaacccgcaaggtaaatggcaaagaactgttaacagatattgaactaaacgcgactgatatcggtacctataacaaggtggaaatcaatgagcatatcagcaaagttgagaagctagctgaaaccgccaaccagaatgccacgaccgcgatccaaagtgccgacagcaaagtccccttgacccgtaaagtcaatgacaaagaactgtcagtcgatattcaactggacgcggcggatgtcggtgcctacaacaaagtagaaactgacacgcatatcaatatcgtcaaaactcaggtcgataatgtcaataaattggctgaaaccgccaaccagaatgccactaccgcgattcagaatgccgacagcaaagtgccgttaacccgtaaagtcaatggcaaagaactgtcagccgatattcaattgagcgcggcggatgtcggtgcctataccaaagtagaaacggacgaccgtattagtgatgtcaaaactcaggttgataatgtcaataagctggctgaaaccgccaaccagaacgccaccaccgcgatccaaagtgctgacaacaaagtcccgttgacccgtaaagtcaatgataaagagctgtcagccgatattcaactggacgcggcggatgtcggtgcctacaacaaagtagaaactgacacgcatatcaatatcgtcaaaactcaggttgataatgtcaataagctggctgaaaccgccaaccagaacgccaccaccgcgatccaaagtgctgacaacaaagtcccgttgacccgtaaagtcaatgataaagagctgtcagccgatattcaactggacgcggcggatgtcggtgcctacaacaaagtagaaactgacacgcatatcaatatcgtcaaaactcaggttgataatgtcaataaattggctgaaaccgccaaccagaatgccaccaccgcgattcagaatgccgacagcaaagtgccgtcaacccgtaaagtcaatggcaaagaactgtcagccgatattcaactgagcgcagcggatgtcggggcctatagccagaaagaaactgacgatcatatcaatatcgtcaaaactcaggttgataatgtcaataaactggctgaaaccgccaaccagaatgccacgaccgcgatccaaagtgccgacagcaaagtgccgttaacccgtaaagtcaatgacaaagaactgtcagccgatattcaactgaatgcagcggatgtcggtgcttataccaaagaggacacagacgcccatatcaaagacgtcaaggttctggcggaaactgccaaccagaatgccaccaccgcgatccaaaatgccgacagcaaagtgccgtcaacccgtaaagtcaatggcaaagaactgtcagccgatattcaactgagcgcagcggatgtcggggcctatagccagaaagaaactgacgatcatatcaatatcgtcaaaactcaggttggtaatgtcaataaactggcggaaactgccaacctgaacgccaccaccgcgatccaaagtgccgacagtaaagtgccgtcaacccgtaaagtcaatggcaaagaactgtcagccgatattcaactgagcgcagcggatgtcggggcctatagccagaaagaaactgacgaccgtattagtgatgtcaaaactcaggttgataatgtcaataaactggctgaaaccgctaacctgaacgccacgaccgcaattcagaatgccgacagcaaagtgccattaacccgtaaagtcaatgacaaagaactgtcagccgatattaaactgaatgcggcggatatcggtgcctataccaaagtagaaactgacgatcatatcaataacgtcaaggttctggcggaaactgccaaccagaacgccaccaccgcgatccaaagtgccgacagcaaagtgccgttaacccgtaaagttaatgacaaagaactgtcagccgatattaaactgagcgcggctgatgtcaatgcctatagtcaaaaagaaactgacgaccgtattagtgacgtcaaaactcaggttggtaatgtcaataagctggcggaaaccgccaaccagaacgctaccaccgcgattcagaatgccgacaacaaagtgccattaacccgtaaagtcaatgacaaagaactgtcagccgatattaaactggacgcagcggatgtcggtgcctataacaaagtagaaactgacacgcatatcaatatcgtcaaaactcaggtcgataatgtcaataaattggctgaaaccgccaaccagaatgccacgaccgcgattcaaagtgccgacagcaaagtgccgtcaacccgtaaagtcaatggcaaagaactgtcagccgatattcaactgagcgcggcggatgtcggtgcctatagccagaaagaaactgacgatcatatcaatatcgtcaaaactcaggtcgataatgttaataaactggcggaaaccgccaaccagaacgccaccaccgcgattcaaagtgctgacagcaaagtgccattaacccgtaaagtcaatgacaaagaactgtcagtagacattaaactggtcgcagcggatgtcggggcctataccaaagaagaaactgacacgcatatcaataacgtcaaagttctggctgaaaccgccaaccagaatgccacgaccgcgatccaaagtgccgacaacaaagtaccgttaactcgcaaagtcaatggcaaagagctgttaactgacattgagctgagcgcggctgatatcggtacctataacaaaaccgaaatcgatgaacgtatcaacaaagttgacaaactggctgataccgccaatcaaaatgccatttctgccatccagaatgccgacagcaaagtgccagtaactcgcaaagtgaacggcaaggaactgttaacagatattcaactgactgcggatgatgttggtgcctataacaagaaggaaaccgatgatcgtatcaacatagttgataaactcgctgatactgccaataagaatgctatttctgccattcaaaatgttgacagcaaagtgccattaactcgcaaagtgaacggcaaagaactgtcaacagatattgaactgaccgcgattgatatcgatgtctataacaaagcagatgtcaacattcttttcgaggacgttaaagaactggcaaataatgcaaataacaatgcggataacaaagtaccattaactcgtacagtaaatggtaagtcgttgttaacagacattaaactgcaagcatctgacctcaatgtctatagcaaaggagaggttgatagccgcatcgaagatgttaaggaactggcaaatagcgcaaataataatgcggatagccgagtgccgttaactcgtacagtgaatggcaaggcgctgttatcggacattaaacttatagcatctgatgtgggcgcttatactaaagcggaaaccgatctccgtatcagtaaagttgaagacttggctaagagcgctaataataacgccagcggccgactggagaaaggccaaaacggggcggatatcccagacaagaaagcgtttgtaaaaaatcttggcctgtccgatctcattgggttaggtatagaatcccgtcgagtcggaacagatgtcaccataatcaagcttggtgatatcatcaagatcaacgggcttgcaatagctagtgaaccgattggtgaagttaattcattcgttatcggtgggattacatactatacccactactacaaaatacagctaccaaccagcttgccaaacggcataatttcatgccatgcaagtattgtcgggaataattttgataatcaacaaccgggttaccttgctgatgtaaaaacacagcgaaataatccaaatggcgtgggagtgtcgaaagatacattgacaatatctgtcacaacgccacaggttggctgggtgcctcacttcgattatcaggttatagggtattaacatacactagaagtttagtcctaccccgttattttgtagtgaagtcgtaccactatagaattggcataaatcaggtgatcgcctcggcgatcacctttaatatgcggtagtttagacccagtctaccagccaagcacattttcctttgcatctccctacaaataaaccagcaccataatctcattaggtatgttgaaaactcatttattcaacaaattctcaaattccttacgatcttcagcacgactattctgttcaatccaatttctgatggattgtttggctttttcctgtaattcatcactcagcaatgcttcaacattgagcttatattgcaggttatcccaattaccataaacccgcaggggcacttttaatttctgtagcttacgcacaaattcgttttgttttccccagccgcctgtcaattgcacccacaacgacatatcggtgttttgtttcagcaaattcgccttgccctgccctgtgatatttaacatgcccgatatcgcagagaggttatcaaccttaagctcaccttgattcagttgcgctctgacagacatattttttgcttcggtaaaatcatcagtattctctggctgattaacttgatcagtcgccctcgaaaaagactgctgaataagctgaggaatgttcaatccctccaaacgcgcattttccaggccaatattcagatcaccctgccagtaatgggtaatagcatattcgtcatagccttcccccagaagatcaccatccagctcaagttgcccactgaataccggtggcagagccagagccgtcaacagtggtttcagctctatattttgcaatagcggtttagtatgtaatttagctgggttaaccgtggcatcaatcgtcgtggggagcgcaaaatgcccaccaaatacatcgccgcttaatttcaagatttctgccattccatcattattgacggctttcaaggcaaaattatcaatatccatgccctgataaataaacttatctgccacaaacgaaagattggcctcaaatgccttcagtaaactcagatcataatttgataacggtgaaacagacgtcgcaatcaccggtttcaataaactgttttcaattcgataatcatgccttgcctgcaaatcattttgcggtaatgcatcccatcccagcagattatctaaattcagttttggcgaactcaggttgatggtgtattgtggcttattttgcaaattaacagcaatattgccgttaagttcgctttcatttaccgtcaacgctagtttttgcagcgaaatgaatgaaggagatgattggtacgccaagctaacgctgcctgttcctttgataccctcagatggtaacccgactcccttcagttgatatttgagcgaactgacatcagccgccaagcgctgcggataatcagagatatcaacagaagtattgaattcgaatgccaactcctgctggtttttattgatcttgctgctgaattcaagattgacgtgatcctgatccctacgctccatcaggaaattgatatcacggatatttaattgggaatcagtatcggtttgccagaccagtaagctatccgctaccttgattctggcaatatccagtttccaaccttgaccccctgccaccggatattggatatcacttttcggcgcaatcggggcttcagcctgtttctgcggctggctgtccggcataaatcgcaaaactgcacctttcagcatcacttttttgactacaaactggtgggataacagcggcagtaattcgacatccagacgcatgttctctgccaccaccgcaggtatttcggcatcaggtgccgtcagtgatatctgcccagtcaaaatgctcagttttggccagatatgccagcgcaaatcatcctgtaacacgagatgataaccactcttcttttgtacctgttcgactatgtagccacgaaaatcattcggattaatcagcacaactaacgcagctaaaccagcaacaatgactactaacaaaataacgagtgtcgtcaacaatcttttcatgacttcctcagtctcatgtctacaagatgaataccttcaccagaaaaaattagtcctcactaattcggctgcctacagctccctgctgatttttgtacttggcatcctgacgtcggttgtaagggcggtcagctgaacccgaaaggggttcaaagctcagcgccccaatcaccatgcctgggcgcaacgccaaaggtaatttgcctgagttataaaattccaaaacaatttgaccatgccagcctggatcaatccggtgggcagtgacatgtaccatcaggccgaggcgggcaagagatgaacgcccatccagccagccaaccaaattatcgggcagtgtgaccgattccagcgttaccgccagtgccagttcgccgggatggaggaagaaaacttctccctccggcaaaacgatttcatcgctcatgacacgatcaagtgctgcattgacctcagctttggggccactcaaatcaatgtaggcagcagtatgaccacgaaaaacgcgaaactgattcccaaggcgcacatcagcagttgccccatttatacgttcgatagggggacgcggggtaattaccagtttaccttcatcaagccatttaataatgtcacggtcacagagtcgcattatttcctctcaaatacgatgatgcttatgaatgcctgaatggcaaattattcgtaaaattggccaatcttggctttcaatatgtcgatagccacgcggttcttcccaccacggggaacaataatatcggcatattgttttgatggctcgataaattgcaggaacattggacgaacggttttcttatactgttcgatgacagaatccaatgtacgtccacgctcattcacatcacgcttaatgcggcgcatcaggcagatatccaatggtgtatctacaaaaatagagaaatccatttcctgacgcaaacgcttatccgttaatagtaggataccttcaaggatgatgacgcgttttggttcaaaatggatggattcggttttgcgggtatgagcaacatagtcatattgaggcaattcaatggattttccggctttcaatgcttggatatgttcgaacagtaaactgtgatccattgaacttggatgatcgtaattaactttataacgttcttccagaggagtgtttttttggtctttataatagcaatcttctggaataacaccgatattgtgatcaccaacctgagcccgtaattctctataaagtgtactggcaataagacttttgcctgaggcagaggcacctgcaatacctacgattgtacacttatgtgcttcatcagccataatagaagtaacctggttaaaaaagaaaaaataaagtggggacatagcattcagtaacgctatgtttggcggattatagggagttaatgacttctattccagagtaaacaagataagtctcgtttttttctatacgccccgcataaaaattccgcgatttcgccttgaaaaatgaaaaaatggccctgtataaacagagccattgatcggcgatgctgatataggcttcatgaaccgatcacaggccagatagcgacaataccaacaaaatcacactaaaatacggatgtaaatacttataccgtattcgtagcgagggattacaataactgttactaatcaacaacgttccgtcgcatatcgacacgaaattgcctaactcaaactgcgcggaaagaaatttccgtaggaattttctctccctgccagtacatctgagcagagatattggcggcaatgtcacggtaaatatctgccaattcactgccaggctggctgataacggtcggttcgccgcgatcaagatcttcacgcagtgagatatgcaacggaatctgccccaacagttgacaatggtatttttccgccagtttctctgcaccacccgtaccaaaaatcggctcctgatggccacagttgctgcatatgtggatgctcatgttttcaataatgcccaatactggcacattgactttctggaacatggcgatgccttttatcgcatcgagcagagcaatatcctgcggcgttgtaataaccaacgcgccagtcaccggaatattctgggacaacgttaactgaatatcccctgttcccggcggcatatcgatgaccagataatccagatccggccacagtgtatcctgtaacatctgcatcagagccttgctcgccattggcccgcgccagatcatcgcgttgtcatctgtgacaagatagccgatggaattcgtcgccatgccgtgcaccataatcggcgccatgtgctgaccgtcaggtgaggttgggcgttcttgagctgtgccaagcatattgggcacggacggaccataaatatccgcatccagaatacccacctttgccccttcctgcgccagcgccagcgccagattcaccgccgtgctggatttccccacaccgcctttccctgagctgaccgccagaatattgcggacaccgttgacgccctgcagattattggcacggcgcagagtacagatatcatgggtaagccgccagtcaacagattttgctcccgtagccgtttgcaaagattgagtcgtttcttccttcagttttgcaaaagcacgcttccagacgaacggcatcattaattcaatatgcagtaccccatcaagcatggcgcaatgatgcaatgctttcagagctatcaagtctcgctctaaagtcggatgcttgaacgttgccagtattttcacaacgtgttctttcagcaggtcaggactggtctgctcgggggattgtgagttcatcccggctccttttgatttgtctttttttaaccgaaaaccgtttgtccatcatagcagaagcgggcggtttgggataagaccaaaattgaaatcgacgccgaatagcgccttaaataaaagtaacgaagatcttgcgttaccctagcgacaatgttcttgatcaggtaacatcaaaagcccttttcaatatacggaagtcagatcctaactatgtctcaagtcgcgaacaaattattggtgacctgtgcgttgccttatgctaacggtcccattcatctcggtcatatcctagaacacattcaggctgatatttgggttcgttatcatcgaatgcgcggcaaagaggttcactttatctgcgctgatgatgcccacggcacgccaattatgctgaaagcccagcagagtgggatctcgccagaagaaatgattaccaaagtgagcctagagcatcagcaggattttgccggctttgccatcagctacgataactaccactctacgcacagcgaagagaataaagagcttgccaccaaaatttatctggaactgaaaaagaacggtcacatcaagaaccggaagatttctcaactgtacgatccagaaaaaggcatgttcctgccagaccgtttcgtcaaaggtgcctgcccgaaatgtaaggccgaagatcagtatggcgataactgtgaagtctgcggaaccacttacagcccaacggaattgattaatcctcgttcggcagtatccggtgcgacgccagaaatgcgcgatacggagcacttcttctttgatctacctgctttcagcgacatgctgcaaaaatggacgcgttccggcagcttgcaagagcaagtcgcaaacaaaatgcaggaatggtttgactcaggtctgcaacagtgggatatcacccgtgatgcaccttacttcggtttcgaaattcctgacgaaccaggcaaatttttctatgtctggctggatgcgccaattggttacatggggtcgttccaaaacctgtgcagcaaacgtgatgacctgaatttcgacgaattttggtcgaaagattccgaagccgatctctaccacttcatcggtaaagatatcgtttatttccatagcctgttctggccagccatgttggaaggcagcaactatcgcaagccgaccaatctgttcgttcacggctatatcacggttaacggcacgaagatgtccaagtcgcgcgggacgtttatcaaggctgaaacgtacctgaagcaccttgatgcagattgcctgcgttattactatgctgcgaagctctcctcccgtattgatgacatcgatctcaatctggaagatttcattcagcgcgttaacagcgatatcgtgaacaaagtagttaaccttgcttcacgtaacgcaggttttatcaataaacgttttgcgggcaaattggctgaccaacttgctgatcctgctctgtaccagcaatttgttgatgcggctgaaggtattgcagaagatttcaccaaccgtgaattcagcaaagctatccgtgaaatcatggcactagccgatttggcaaaccgctacgttgacgaacaggcaccgtgggttgttgccaagcaagaaggtcgggatgccgatctgcaagccatctgctcaatgggtatcaacctgttccgcgttctgatgacttacctgaaaccggttcttccaagcctgactgaccgtacagaagcgttcttgaataccgaactgacttgggatggcatccgacaaccattgcttaaccatgaagtttcaccatttaaggcactatttaaccgtatcgagatggcaaaagttgacgctatggtggctgactccaaagaaagcatcgagccacaaaaaaccctgacaggcccactggccgatgatcccattcaggacaccatcgcatttgatgattttgccaaggttgacctgcgtatcgcactgatcaagcaagctgattttgtcgaaggttcagataagctgctgaaactgacccttgatcttggtagtgaaacgcgtcaagtcttctccggtatccgttcagcctatccagatccaaaagcgctggagaaccgtctgacagtgatggtagccaacctcgcaccacgtaagatgcgttttggcatttctgaaggcatggtaatggcggctggccctggcggaaaagagattttcctgttaagcccagacagcggtgcacagccgggaatgcaggttaaataaccatcagataccttgtgaaattaaggtataatgataaacaacaaagcgggctcaaaaaagagtccgctttttaatgtgacgtatggcacatttacagagttagtcgtatgataaaaccctcgttatattgaggaattatgtttatgtctttccgaaacatgctggtgataggctggcaatacctgcgtgcattcgtgctgctctatttgtgcctcatcgcaggaaatatcatttcagcactacttcccttctctctccccggcagcattattggcttacttcttctgttttgtttacttgcattccagcttattcctgcatattgggtgaaaccgggctgtagcctgttgatgaaaaacatgacattgctgtttttacctatcggggtgggtgttatggattattacccgcaacttagccagcaaatgttcccgattgttctctcctgtatcgtcagtacagtaattgtcatgattgtcgttgcttacagttcccattatgtccatcgcgaacgcatcattattggcgctcaacgaaaagaacccgatctcagctccccgccatcacaacaatcggacaaaagataaaaatgttaagccatatctggtggtcactgccattaacactgctcgtattttattgcgccaaaaaattgtcacggcaactcaaacttcccatctttaacccattgttgctatcgatggccgttatcattcctttgctactgatgactcacaccccctatgagcactattttaccggtagcaggatcttaaacgacttactgcaacccgccgttgtcgcattggccttccctctttatgagcagctccatcaaatccgcgctcaatggaaatccattattagcatctgttttatcggtagtattgtcgcgatggtgacaggtacagctatcgcgttatgggcgggagccagccctgagatcgctgcctctgtgctgcccaaatccgtcacaacaccaattgccatggccgttgcggattccgttggcggaattccggctatcagtgcagcctgcgtaattactgtcggtattttgggcgcgatctttggtcataatttgttcaatcttctagaaataaaaacgtcggcttcaagaggattagccatgggaacggcatcccacgccgtgggtactgcacgctgtgccgaactcgatcatattgaaggtgcatacagttctttggcgctgatgacctgcggcattatcacctcattaatggcaccttttttatttcctgtactgcttcatctatttggctaatattttgctagttagcagctcgtgatcaaacggtgaaaaattcataaaaatagtaaaaatttgatataagttactaaaataatgtatctattacactcatttcactgattatatggcgtttatcacattacaaacctgagcagacatcctagaataaccttcaattaatttggagatcattctatgcaagctcgttttcacgctatttggtcagaaattacccctaaactgcaagaagccctgttaccctatatcggcaatgacgattttccagcgatgctgaccgcagagcaggttgaatcaatcaggcaaatctgcggttttgatgatcatgcgctggcacttgctctattaccacttgcagcggcctgtgccattacacctatctcgcatttttacgtcggggcaatcgcacggggagaaagtggcaacctttattttggtgccaacatggaatttgctggagtccccttgcagcaaaccgttcatgccgagcaatcagccatcacccatgcttggctgcgcggtgaaaaaaagctggtttccatcaccgtcaattattcgccttgtgggcactgccgccagttcatgaatgaattgaacagtggaacacaattggaagtctgtttacccaaccgcccacgattgacgctggctgactacctgccggaagccttcggcccacgcgatttgctggacgcaccattactgctggataccgtcaatcacggctaccaattggatacctgtgacgcattagtgctggcagcactggatgcagcaaaccaaagtcatgctccttacagccaatcccatgccggtatcgcgctgctggatgaacaagatcaggtttataccggccgctatgcggaaaatgccgcatttaacccaagcctaccacctttacaggcagccctgatcttaatgaatatgtctggtggcaattgtcagtccatcaaacgggcaatactagtggaaggaaaaaatagccatctatcccaatcaaacgcgaccgaatccacattaactgccctcggttgcaccaaaatagaatgccatagattttgactacccatctcaaaaaaacaacaattcagcaaaaaattcgggcaaacatgaaataaagataacttaacaaaatggcaaaattcccctctggatcgctcggagggggtaaaatcgaaaaaactcataacatttaattagctaattctgtaagttatctctcatttttgctcatgataaacataattaagtaacatttactgtacttattttttttatcttcttaggatctatagctgattttgttattgattagtccaaagagtaagtatcatggaactggaacacgaaagtaaacgtcctctctatattccctacgccggccctatcttgttggaatttcctcttctgaataaaggcagtgcctttactgaagaagaacgcagcaatttcaacttacatggtttattacctcagatagttgaaacgatagaagaacaagccgagcgtgcctaccgtcaattttgcgattttaaaagtgacggtgacaaacacatttatttaagaaatattcaggacaccaacgaaaccctgttctatcggcttcttgatgcccatctcagcgaaatgatgcctatcatctacacccctacggtgggtgaagcatgtgaacacttctctgatatttatcgccgcgcccgtgggctgtttatttcctatccaaacaaagcgtctatcgatgacatgctgcaaaatgccaccaagcagaatgtcaaagtcatcgttgttaccgatggtgaacgtatccttggtctgggagatcagggcattggcggcatgggtattcctatcggtaaactctcgctgtatacctcttgtggtgggatcagcccagcttacaccctgccagttgtactggatgttggtacaaacaacccgcagcgtctgaatgacccactgtatatgggctggcgtcacccacgcattaccggcaaagaatatgatgaatttgtcggtgaatttatccaggctgtgaaacgccgctggccaaacgtgctgctgcaatttgaagattttgcccaaaccaacgccatgccgctgttgacacgctatcgtcatgatctttgctgtttcaatgatgatattcaaggcacggcagccgttgccctcggcagcctggttgccgccagccgcgccgctggccgccagttgagagatcaaaccgtgaccttcctcggagcaggttctgccggttgtggtattgccgaacagatcgtcgctcagatgaaatctgaaggattgagcgatgaacaggcccgcgcccgcgtgttcatggttgatcgctttgggctgctgactgataaacagccaaacctactggacttccagagtgtactggtacagaaaagcagcgtcctgcaatcatgggatgtcagcaatgacagcctttcactgatggatgtggttcgcaatgccaaacctaccgttttgattggtgtttccggccaatcgggtctgttcacggaagagattatccgtgaaatgcacaaacattgtgagcgtccaatcgtcatgccactgtccaacccgacatcacgtgtggaagcgcgtcctgaagacatcattaactggacagatggcaaagcgctggtcgcgactggcagcccatttgcccctgtgaagtatgatgggcaagaatacccaatcgcacagtgcaacaactcctatatcttcccgggcatcggtttgggcgtcattgcttccggcgccagacgtgttacggatgatatgttgatggtagccagccgcgcattggcggattgttcaccgttggcacagacgggttcaggtccattactgccaccgattgatgatattcaaaacgtttcccgcaaaatagctaaagaagtggcgaaaaaagcccagattcaaggcatggctaccgtcacgtcagaagatgcgctagaacaagccattgagcgcaatttctggaaaccagaatatcgcgtctataaacgcacttcattctgatctaagacctgctaagatcagctacaagcctgtcagcaccgttggcaggcttttattacagtccgaaaacttgcttcaatatttcaagtaaagtagcctttaagacattgaatcatgagtacacacaaggtaaacagaaacaatgtggaaacgcctgattaccgggttggttttcatcatggctgttctaatgctaacagtcattatgcttgaccgctggattagctggaaaaccgccccctatatttatgatgacctcagccagcttcctgaacgagaagtcggtatggtactcggcacgtccaaatattacacatccggcgcctataaccagtactatttctaccgtattcaaggggctgctaacgcctacaacagcgggaaggtgaattacctgttactgagcggagataacgcccaactcagctataacgaacccattacaatgcagaaagattttatcaaggcgggaattccggcttccaaagtgataatggattttgctggctttaggacgttggattccattgtcagaacgcgtaaggtctttaatgccaacaattttactattattactcagcgtttccactgtgaacgcgccctgtttattgccatgcatatgggcatagacgcacaatgttatgccgtctcttctcccaaaaatatgatgatcatacgtttcagggaagtatttgcacgcctcggagccttggctgacctctatattttgaaacgcgaacctcgctttttaggcccattaacaccgattcccagcgaaactgtcatcccaacaggtattgaaggctatcctgccgtatcgccaggagagttacaggaattggggaaaaagcctcgcagttaataaaagtagaaatagaataagagcctattggataggctcttaccttttcacttaaaccctgccagccagttttctggttaaatcacgccagagcttttcaatcggcccttgctgataacgttttaaccaccagcaggcaaaccagatattgaaggcccagatcaacgggataaacaccagcaattccaaacgagtaaactgatcaaacaatccccaacgataaaaaatcgtggtacaaatcaaagtttgcagcaagtaactggtcagcgccattctgccaacttgtcgtaaccagaaattcactcgccaatgggaaatgattggccaaaaaccataaatcaacgcgatataagccaatgccagcaagggcgtcgccagttcggagatagtatgacgaatcgtccatgaggcaaaatagctgaagggatataaacactgtattgacagagcaataacctgaatgaccatacccaacggaagtagccataatgccaccctgcggtaatgactgaggctaaactcccctttcagccagccattgcgcagcaacatcgccccacagagcatcgtcccaaccatttgccagccatattgcacgataaccactatcatcatgccacttacctgacgaaaacgatgctcgatagccaataacccaccctgggttttccaatgactttcatgaaatatatcctgcggtgttggctgccagaaggcactattttctcccactggaaacaaccccagaagataaaacatcatcaaaccaaacagataaaaaataattcctttaccaaacaatctatggcgagtatggataaagtgccatgccaaaagaccggcaatgccatataacagtaaaatatcaccatcccacagcaagataccgtgcaacaagccaataacagccagaataatcagtctgggaatattccattcactcccccgctgccacagtaattcaagtgaagcaccaaataacaaggttaaaatgaataaaaattttccctgagtaaaaaaactcaggacagaccatgtcatcacatcagaaaatgagatcgaatctttataaaaaagattcatagaagcggcatatggcaaggcaaaactgaaaatattcaaaattaatattcccagaatagcgaaaccacgcacactatcaattgcctcaatccgctgacccattacctcactattttccatggcaataaaagttcatcatgataagtgcaggtgacgcacggcacgcagaaattcctgtcgtgtattctgactagatttaaacaaaccgccgagagaagttgtcgtcgtcgtgctggtcgcatcgcggatgccacgggctttcacgcagtaatgaacagcatcaatggaaatggcaacgttatttgtaccgagcagcgtttgcagtgcaatcaggatctgctgtgtcaaccgctcctgcacctgtgggcgctgcgcaaaaaattgcacgatccgattaattttcgacaggccaatcaccttatccttagggatataagcaaccgtggctttgccatcgatagtgacgaaatggtgttcacaggtgctggtcagcgtgatatcccgcaccgttaccatctcatctactttcattttattttctatcaaggtgattttcggaaagttgttgtaatccaatcctgaaaatatttcatctacatacattttcgcaatacgactcggcgtatccgccagactgtcatcactcaaatcgagatttaacagtttcataatttctgtcatgtgttcctgaatccgtaccttacgcacttctggttccagagtttgttcacgcaatggggtttcaaggccacgggagaccagtgccgagtgcaccagcgcagcttctgtacttagggatgacatcagtttctccaagaataatactttccgttacttgacggggaatcgagacgcatattttacgcagatatctgtgaatctaacaccttacatacaatataggttcacaaaatacctgctgacatgatatccactcgcgtggtatgtacttacattgtatctgtgtacaactatctctgcacgctatcaatacgcccgatctggattactccttatgattctgattgcgcttgaatagcagtaatccagcaacgaccaaacaaataaatccgatatacaaagcaggctccaacttgcccgtcagccacgtcgaaatagccgacagcactggcccgactaattgtcccaacgcataacccgtggtcagcaaccccgccatataacgagcctgattcggcgctaattcacgcccatacaacaaggccagttgtacaacacacataaacccaccaccaaccagcaatgccccaatcaagaggcctccaataccctgcagcacttctgcaatcaatatgccaatcgcctgaagccataaagttatcgccagacggatgcgagcagtcgatacccagctcaacaaaattcccagtacgatgccaagtgcagaagcaccaccaaatatcggccagacaaattgtgcaaacaggctgtcaggaaaacgctctgttgccatctgagaaaggaatgtggcgggtaggatatagccaaaccctgccagactgtagctccatatcaaccgtttgatttccggtgtcagagtaagtttttggatgttagtctgtgggcggtgcagttcaccacgacgaggcagatagcggctgacatagatactgcataacaacgccaacatgccataaatcacccaagcgttggctgcactcatctcccaagattgaatagcaacagccagcacaccactgattaaaatccctattccggttccggcaaagacagcggcactcaatcccggccgatgcagttttgccagttcatcgttcgcccatgcagcgaccaataccaacgtccaaccactcgcccagccaataaagaaacgagcaatactatgcaatattggcccatccagcagtgccgaaagcaacgtgatcatcaccgccccccacagcccactccacaggcggtattccacgaatcgctgtgctcgcatcgcatcataagagccagccagataaccaaggtaattaaatgcagcaacaattcccgctcccgtcagtgtaaattgggattcagcgatcatcagcggaacttgtggagtaaaagtgaagcgtcctattcccattgcaacaactaaagcgagaaaaccgctcaatgcaatttggaaggcttgataatgacgacggccagaagtgatgatttgatttctcatagtgattaaaaaataatgggattaattgttttaattaacattattcagttataacaaatcataaatataatacacgtcttttcttaacatttcgttttttctctgatatgacaacaattctccatcaaagcgatctttgccataatgcggccagcacaggaataaacgtttatccgctatcggcggcatattgggagttctttatggatcattgtcatacctcaggcttaatctcgctcgaacaagcgctggaaaaactattggcacaagctgttgccctgactcacacagagaccatcagcctgatgcaagccgctggccggatcaccgctacagatattatttcgccaatcaacgttccctctttcgataactcagcaatggatggttatgctgttcgtcttgccgatctaaacggaaatcaggctttgccaatagcaggcaaggcattcgctggtgcgccgtttcaaggagaatggcttgccggcagttgcatccgtatcatgactggcgctcccattcccgcgggtgccgatgcggtgataatgcaggaacaggctgaagttacagaagcaggtattcgattcccctatcccgctcaaccagggcagaatattcgtaccattggagaagatatcgctcagaatgcggtcgtattgccaaaaggaaccaaactatccacagcacagttgccggtgatcgcctctctgggcattgcaaaggttaaggttattcgcaggttgaaggttgccattttttctacaggtgacgaattacaggcgattggtgagccattacaggcaggtcaaatttacgacactaaccgttttgctgtgcgcctgatgctggaaaaactagactgtgaggtaatcgatctcggtgtgatttccgatgatcctgacgcattgcgcgatgcctttgccaaagccgataaacaagcagatttagtgattagcagtggcggggtttctgtcggtgaagccgattacaccaaagcgattctggaagaagttggcaaaatcaatttctggaaactggcgattaagcccggcaagccttttgcgtttggcaaattggaaaacgcgtggttctgtggtttaccgggaaatcctgtctcagccgtgctgactttttatcaactggtacaaccgctgattgcccgtctgtcaggttttacagcatggcaagcgccaatgcgcctcaatgctaaggccatcacaccactgaaaaagtccccaggcaggctggatttccaacgcggcaacgcttccattaatgaacatggcgaattagaagtacaaaccaccgggcatcagggttcccacattttcagctcatatagcctcggtaattgctttattgtgctggaacgagagcgtgggcacattacggcgggtgaaacagtgcaaatcgaatttttcaaccacttactgaaaaaccaataactaacgggaaaataatggctatcgagctcaccgatgaagaaaccctgcgctacaatcggcagattgttctgcgtaatttcgattttgacgggcaggaaaagttaaaatcagccaaggtgttgattgttggtatgggcggtctcggctgtgcctcctcccagtatcttacttcggctggcgttgggacaatcaccctgctggattttgatgccgtttccctctccaacctgcaacgacaaatccttcatcgcgatgagcgcatcggtatgcccaaagtgcattcggccgcccagacactgcgggaaataaacccgcacgtcaccttacatcccattgagggattattggatgatccatcactggatgaattgattggccgacatgatcttattctggattgtacggataacgttgccattcgcgaacagctcaaccgcctgtgttacgggcgtaaagttcccttggtttccggtgctgctattcgcatggaagggcaactggccgtgtttacttatcaaccggatgaaccctgttatcgctgcttgagccgattatttggtgaaaacagcctgacctgtgttgaagcgggcgtgatggcgccactggtgggaattatcggctccctgcaagcgatggaagcgattaaattactgactcaatacgggaaagtcagccgtggcaaagtgttattgttcgatgccatgaccctgcaatttcgtgagatcaggctgcctaaagatcctcagtgtgaggtttgccagagctaattttaacaacaaaccctattctatactcactgcctttcctacctgaaaaaacgcgggttaaggggaataaaaatattgatgatgatttgataacgttatctgatgaagatcaaatttctttacccgaatactcatgtgatgaccacatacagacattactcccttcttttatattccttccttagaatcgtattcgagctatggtgagatttccctggtcttgtattataaaatcttaatagataacatagtattataaatcaccatcaatgataatataatatcaacgagattatataatgcaagaactgaatggtaaaaaatcaactgaagctgatgccttgttatccaacattgctaaaaatattgattttttgatgaaaaataacaacatagactcacagactctgagcagattaacaggtctcggaattgcgactatcaacagcctcagacgtggagttggaaaccccactattgctactgtttcatcaattgcagatgtatttggtgtcaatgtgggtgaaattaccgacgggaaattatctgaatcaaatggaaatgaagaaattatctcctcagtacctctggttaggtatgatgaattggatggttacgtatctggcaaaataatcaccaaaaatttatataagctcagtattcaggataatcatgaagattctctttttgccgtagaatttggaaataaccttttatttccctattttgacagcaacaccatcgcaatagtttctaaaaccgaggcagtttgtgacagtgatgtcgttctcgtaaaaattaaagatgctcccatttgttttagacaagtttttgtcggcgaaagtggaatttacttttcaatattaggcattgagaacgaacggaaaacggttttaacgcaaaattacacaataattggagttgtgattaggtcgattagaaacttaaaataggatttaattgtgggtaaaataataagttttctcaaaaaaatattcgaaactcgttatatatacagtttacaaaaattcgaacccataaaggaaaacggattttatatcttgaaagagctaggcacccatacatgcataaaagcaaaagcagaagatatttttgacggcgatttattatacaatatcaatcctcaagatattatattcatagcaaggttcgaagaatatgatatgagagaaaaacaaaaattcaaaataatagaggaaaggagagatctttcatttatcatacagaatgcgtattctcgcagacaaattcatgggaaagaactgcttatagaacagaatatagtagaaaaaatagatccgacgagccttgtgagaatagcctatatgtcaggattaaaagatggaaggaaaatttctgacgatatctcaaaagctgaaaaaataaaaccctctaaatccccaaatttaaaggtaataaaatgactcagaattatcccactcattcaaggtttaagtatgattcgttgtttatttctctatctgtaacaataatgataacttgtgatgttcttgtatataaaacactagacttttatgattttaaaattacatttagtggaattttgttctcgttctactttcttatatccacgattcagacggaggtttatggatacagacaaggcgtaaaaacggtctggatcatggtgttatgccaatcaatctttgtcatggttatctttgtagcgtcgcatatgcaacccgaaaacaatcaaatatcaatgaactttaagtcattattcggagaattttggcgtgttatggtagggacatggacttctgtacccatttcttactttattaacggatttgttatatccagcctgaaaaaagtctttcttggcaggttctttttcatcaggtatctcattgcctcgatgacgactcaggcggctcttctgttatcagcttatcctataagcctctcttcaaaatataatttcaatgaattaataacaataatcacaacaacatggtcttacaaagtcgtaatgtccattattcttctgcctatagggatcatcttagcggataagataaaaaaattagagtcggctgatgtatatgattggggcatatcatacaatccatttttcctcagaggtaataaaaaatgaaagttgttaatttgacagacatacacctgaccagaaacagagataaaaaactatttgatgtaaatccttatgataactttgattttgtttgtgaggaaatacgtagaatacagaatcttactgggatagagttaattatcgtatccggtgatattgcaaatgacggtgatattgacgcctacagatattttttaaatagaatggagtcactaaaaataccttatatttccatactcggcaatcatgatctcaataaaaactttgaaatagcactggcggaagaaaaaccaaaatacattattacctcccgtgaatataataacaataattggtatatgacttccgtcgacactgtcgttgaaggagaagattatggttttataactcaagataaccttgctgaattagaaagaaaaattatcacaaacagcaattttaatatcgccatatttatgcatcatcatgccatgccggttggtacgccaattgtagatagctgcatgctgaacaatgccaaagcagtattggaactttgtgagaaacataaggttaaatttattggtagcggtcatgcgcacacaccacgcatttggcatcataataatatgacagcatgtgtttctcctgctgtttcatttcaatggttatcaggcaccgatacagtgaaaatatcaaaaggctttggctttaatgttatagattttgtgccagatttatctataacgtcatgtatttattaatcgtcaataatggcaaataaaaaagcgcttcatatgaggcgcttacttattggttgatacctgatagggtactttatcggggaattacatccttgtattcacttcagccattccgccctcaatcctcaaactgaaaaataatattctcttttaagattcatgcgggcagaaaaaaggctttactcagcaattccctggcttctcagatactcatcataagtacctctgaaatcaaccactttgtcggatttaatttctaaaatacggcttgctaatgagctaacaaatgaacggtcatgggaaacgaaaatcaacgtaccttggtagagttccagcgcaaggttaagggattcgatggattccatatccagatggttggttggctcatccataatcagaatattcggtttgtgcatcatcagcttaccgaacagcatccgtccttgttcaccaccggacagtaccttgaccttcttcttgatgtcatcctggccaaacaacaagcgtcccagcgcaccacgcacggcctgctcatcgtctccttcgcgcttccactgactcatccattcaaataccgtcagatcgcagtcaaaatcgctagcgtgatcctgcgcataatagccaatcgtattattttcagaccatttgatcgtaccgctgctcggctctgcttcacctaccagcgttttcagcagcgtagttttaccgatgccgttttcaccaataaccgccattttttcgccaacttccatcagcaggttcaggttcttaaacagtggttcgttatcatagcccttggttacactttccaactctagcgcattacggaacagttttttctcctgctcaaagcggatatatgggttttgacggctggaagctttcacttcttctaactggattttgtcaatctgacgagcacgggacgttgcctgcttagacttagacgcattggcactgaaacgactaacaaatgactgtaaatcggcaatctgtgcctttttcttggcgttgtctgccaactgacgttcacgagcctgcgtcgccgcagtcatgtattcatcatagttccccgggaacagacgcaatgcgccataatccagatctgccatgtgggtacagaccatattcaggaaatggcggtcatgggaaataataatcatggtgctgttgcgttcgttgagcacttgttccagccagcggatagtattgatatccaagttgttggttggctcatcgagcaacagaacatcaggattagaaaacagtgcctgtgccagcaagacacgcaatttccaacccggtgccaccgcgttcatcaaaccataatgctgatccacagggataccgacaccgagcagcaattctcccgcacgtgcctctgcactatagccatccatttcaccgtaggcaacctccagatcagccacacgatagccatcttcttcgctcatttctgccaaggcataaatgcggtcacgttcctgtttcacttcccacagttccgcgtgccccatgatgaccgtatccagcaccgtgtaggtttcgaaagcgaactgatcctgacgcagcttacccaaccgctcattgggatcaagactgacattaccggcggttggcgttaaatctccacccaggattttcataaaagtagacttacccgccccattcgcgccaatcagaccataacgattgccgttgccgaatttggcagaaatgttttcaaatagtggcttactgccaaactgcatggtgatgttgtttgtacttaacacaacttttgctcttaaagtggataaaagggaatttggaaaaaatcgatagtcgcgcattatgccacaacaagaaaaaagtatcgccagaatacctcgacctctatctcaaaaaccaaaacacagaccccgttcacataaaaaagataaataaaattttcttatggaatagactatatagtatcgtcatgaaatttgcagccaaagcgcgagacaacggatctgaactgcggcgaggaaagactgactgtttttcgcatatcgcgttgctataccacgccagcgtttaagatgaaggaatgcattttcaaccaaatgccaatatcggtagagttccctgtcatattcccgttttatccggcgattttttcggctgggtatttgaacctgcattccttgatgttcagcttgctccacaatggtgttactgtcatagcctctatccgctaacaaatgttcggcttccattcccgcaattaaggcctccgcttgtgagcaatccgctaatccgctgcggtaccgcttgtaataagtactctgagcggcataccatgcgcatccacggccaaatgtatcttgatgttgagcccccttttgtacgtcccatatcctgattaccccctttacgccccggcaaatgtggctcaagtaagtcccctatatgatttgaaatatcatgacggcagtgcaagggggtgttcattgctaatgcaactctatttatgggatatattgattattgcacaaaacatttcatgacgacgctatgtaagaggctatcccaatagaattatattccagacaattaaactacaagccaaatgaagcatggcttcataattttcaacacgcttttcccaacgtaccagacactacttgaagaacaaatccctgtggcattaagggcattccactggcatccggttcgtaacacaaaaaagatagtattcatggcggctcgattatcgacccggagacgatagcagcccaaaggatgacggattttgtattttgtatggaggtagcaggggttcaattttttaccagagttcatcagaaatgaaccattatactatcgacttcttattcatgaaaaaaaaccctaaatgtaaaaaataggctgattatgatataaaatacctcctattgggatactctattagactgtattttgccttttatatttttcaattttgtgattaaggtcactacaatacataatattatataatgaaaatccaaccaatttcagttagtttgatatggctgcactaatttaatatacctcaatccaatataggaagtagtaaatgaaagatgttccaataatcaactcccgtatttttagtgtaaaaagtagaaaagaactattaactgaatggtctgaaatctctgaaataatcaataatgaaaatgaatatgatggctcaggggtagtttctttcctaccattaaatagactcaatagtaattcagaaagagaagaatgcctgaatgttatttctaaggtcatggaaactggtaattttaccagcggttcttatatttcagaagtggaaaaatatctgtgtgaattttatcaggctgatatttgtgtagctaccagtagtggtacagatgcgctgaaaatagcgcttaaagcggcaggggttggacacagtgatgaggttattctgcctcttaattcttttgccgctacagagaatgctgtcatggctataggagcaatcccgattttcgccaatatggatgcatcttataacattgcgccagaagaaattgaaagattaacaactcctcgaacaaaagcagtattaccggtatgcctttatggctcaaccaaaaatatttctgaagtgtataaaaaagcgaaacagcataatcttctggttatagtggacgcagcacagtgctttggaattaaaaatgtcattggatactgtgatctaatggctctcagttttaacccctttaaaaatattggaacggttggtaaatcaggtgctgttctgacttgctctcctgaactggcttgccgagcaaggcagtattcatatcatggttttgcagagggaaaaaagaatattaaggcacaaaattgggggtttaatagtcgtatggataacatgcaggcggcaactttgatggtgaaactgaatcattttgaaaaaaatgctacaaaacgtgcttttcttgctgcgaggtatattcattctcttaatcaccttgagacggatttatcactcccatctgaaagaattgaaaatacatggcatctttttccattagttataaaaaaacgaacccgagatgaattactccaatttgctaaaaaacatcatgtagagttagatgtttattaccccgttttgtcccactgcggagtacatgaactggcaacgcattatccagacaggaaacaatttctatcttcagaacgaattcataccaatttggtacaactgccgcttcataaccatatgtccttacaggaacaagatattgtcattgaggtattaaatgaattttttaactgaaatattaccaccggaatttccttgtccagtaagcgtaaaaaccttggtgtgctgtgatcttgacgaaacttatatcccattttcactggaaaacaaaccttttggtggggtaagagaacttgaacaatttctatgtgaagaaggtaaaaaaaaaggaatcctattgggttggataactggaacaaatttaagttcagcgatacgtaaggcaaaaggatatatatccagaagcccgcattttttatgttgcagtttgggtacggagttttattgggtcagaaatggaaaattagtcccttctgtttcttgggctgaaagaataaagaaatcaggttacaacagggaaaatgtagaaaaaattctatatttgattggtgaaaaaggtatttttcttgaaaagcaacctgatgattatcaaggaaaatataaagccagtttctactatcatatccgtgaagatatggagagtgattttgaatggattgaaagtatcgcgaagacatttcaaatccgcacatttttcactaaatctaacccagcggctggtgatccggaagattgttatgatgtagaatttattccttattgctgtggtaagggagagacggtttcgtttctgatggaaaaaatgcatattccccgaaattcagttcttgcttttggtgatagttgtaacgacttacctatgttcgaatgtgtgggtcattcttatttggttgcgaacgctgaaaaaacagcaatacaaaaacatggaagcaacttaaataaaccttattgtcacggcattctcagcgtattgacaggattgtaattatggtaatcggtattattggttgtggcggtattgcgcgtgcacacgtctattccctatcgctcataagtatggtgaaggggctggcgttttacgatgtcagcgacgataacatgcgtcatctcagtaaattatcagcattaccagtcatattttgttctagtcttaaagaacttgcgattcatagtgatggatttattatttgtgcaccaaataattttcacgtcagtctcgcagaagaagttttgaaatataaaacgatcccatttgtttgcgaaaagccattgtccacagatctcaaatcagcaaaaagattagttgaaatagctccgctcgctagtattgtttcttttaactatcgttacaataaaatagttattaagatacaagaaattatagagaaacgggcactgggtaagttaaatttcttttctgccgaatttaataagaattcggcattaatacgcaacaatctgacttggcgtgattcatcacaacaaagtaaaagcagtggagcattaggtgatttgtcctgccatttgcttgatctgttctgctttcttgccgaagacactattagaactatacgcaattaacttgaagatgcaggaattaaagtctggaaattatctgtcaaccgggtggtgagttctttcgctttttctggcaatgtgacatgaaaaaagtgatgcagcgtttcacggaatgtttttgcctccgagaaatagatattgtttcgtacctgctcattcgcatacttccataatcgctcaatcgggttgaggttagggctgtaagggggcagataatgcaactcgatattcaggacctcggcaaaaaattgaactatttcagcgcggtggtaaccggctccatccagaatgagatgaattttttgtgaaagcggataggtttctcgaattgagccgaaaaacaggacaacatttttcgcgttaatcgtcggatattcacgaataatggtctcttcaatccgttgcaaattgagtgcgcccatgatgttaaggcgggtccggctgcctgtggtttcgaccactttgacatgctctcttccgcgcctcatccagccgtaacttaattttgtggactgggtaggatgcatcgcatcaataaacaaaataggcgcattttggccacattcagctttcaacgcgttgtaggtcttaataaagtgttgctgtttatacacatcggatttatgaggcgttcccatcggcttcttgtagctgaacccttggcggtggagccattttgtcatcccagccacagtgaaagtcacctgccagcgcgcccagacacaagccacaatttgcgcggtagtgtgcatcaaatttgccgtcagatactccactaattctgtcgtctgttcggcagataaacggctttcagagccgccattttcaggggcgagtttttcctcagagacgtaatccttcagatggcgactcaccgtactttcatgaatacgcaaagcctgggcaatcatctgggcagtccagccttctgaggccaaaagcacggccttgatgcggtcacgtacgcgcccatcacgagtcgtatcgtgcatcaattcgagggcttctttttgggcatctgtcagagtaattttcatgggcgcgatcttgatctgatacgaatgaaaaatcaagtatcttcaattacgatgggtatagtgatctcagagtggttaaaggcactagggttaacaataagtcagatggccctgtcgaggttgatgataacggctatgtatttggtagggctgatggaggggcttttttccgcattcgagccagcaaatctgatgatgatgggagccagttgggactgcatataaatttagtatttgatgagggtgaaattcattactctacaacagatgaaaacaaactttttctgacgtttttcagtaaacttggcgtagaggaagttatgcttgaaacccgaaagattatacccgatcccaatcgtgaactgcctttctggtctgactcattttactatcttttactggattggtgccgtttactgcaaaatcatggcaagtcaaaagctctaccttttctgcctgccggacttcacatacaggaaatcatagaagagttctgaaaggaaaataaataataatggatatgacactttttattggcctatttgcagctttcttcactacgtttgcatttgtacctcagagtattaagacgctgaaaaccagaaatacggagggtatttctctcattatgtatataatgtttttgattggcgtaatttcgtgggtcgtttacggttttaagaagtcagatttggcggtgttggttgcgaacgtaactactttcgttcttgccgcacctgttttgatcatgacggtaatatcccgcattaggaaacgttgatgatagtggcaataataggtgttgtattatagttttccgtcaacaagttttcagctaaataagctccctaaatgggagtttttctgaatgatagcgtggtattgggaggatattctgtggatataaaataagttatgctttttcgacgaataccgccctgatagggcggtattaggaagaattggaattggtagaatcactgttagataatcgaaaataggttggattacttagaagtaatcgaccaaataaagtcaaaaaattcgtccataagtgtcttcaaatataaggaatcattaagcagtttttctcgagacaagacttcaggagagaacactattttacaccacaagtcgtacgctccttttgcttctgagtgaaaagccaataactcagtgtgggaaatttcttgcaattcatcctccttcagttcttttttagcttgttctaacctgtctaaaatgaatttttccgtagttgtcgtgatatgagcgtaactggatattatcatttccatgttgatgaccttattcaaattttttgggcttatttacagtgttttcgcctctagctcagttactgaagttgtccaaccgactgattagcaatgtattattcaaatcattaactaaccgtgaaagttccacttttgaaaaattgttttttacttcaccctatgatatgaacaatattcgccaacttgttcaatttgcatcactattttcaatcagtacgaatgaattttcagttcaagctctggagaaaattattatctctttaccaaaaaaataggtaaattagggggtcattagcatttctgatactgaccatatgattccgctgcttccccattcaacgcatggtgctcagtgctatcctactttctcctatttatgcattttaaatttttgatagctgttgtgtgaatgttaaaatgctatggtttcctctttacataaacctatcctacatataataggtttaacctaatttttagtgtgtttctactacattgatcataaatcagttaaactgaatgttatataatccgctaaatcgcttcaacataaataccaacctcagcagaaatagctaaatagtatggtaatccccctaaaaaccggagtgttcataagtggaattttctcgtcatcttaatgaatcagaggagatccgaatcttatgaaaaaatcacgttttactgacagtcagatcttaatactacagcgtactttcttttctcaatagaaattatacctacaggaagtaatcctcccatttttcatggaggttaaaagtagaatttaagcaacacgtaatatatgttgctttggtgggtcatgtattcaatccggtgaacatcatgtaatatagggcaatttactggagagtcattaatggctaaagtggatgtgaaatgcccgttttgtcagcaaacgcccccggtgaagaaacagggtttagggagtaccggccatcagcgttatcgatgtcaggaatgctgccgtagttttcaacttgattatgaatatcgggcttgtcaccctggtacgaaagacaaaatcctcgacctgaccatgaataatgcgggcattcgtgataccgctagagctttgcatatcagcattaatgccgtcgtccgcactttaaaaaactctcgcctcgacacgtaaccacgttaccgctcgacaacttgcaagttgagctcctctgtgaagtggatgagcaagggtcttttgtcgcaaataagaaacagcagcgctggctatggtatgcctgggagcctcgcctaaaacgtatcatcgcccatacttttggtcgccgaaataagcgaacacttcgcaagctgcttgccttattgtctggatttaatgtggcttttgggtgcacagacaaatttagagtctacgagatattacccggcgaaaagcacatcgcgagtaagctttatactcagcggattgaacgagaaaacttaaatctaagaaatcgattgaagcgactcaatcgcaagacgttaggttactcgaaatgccctgaaatgcatgacaagatcatgggtacattcattgagcgtgagcattatctattttaacaataatctctatattgaatacactaccctttggtgtatagccacctaatgccatattgggtctttcatgatgataaaaccactgccattttgttgcatagtcttgtaattcactcaaaatagtgtcccagccagtcataacgaaccgttcgattataacgctcaatataggcattctgttgaggctttccgggttggataaaactcaacactatctcatgcgtcttcgcccatgcctgaaattcatggcgggtatactctggcccattgtcacaacgtattgaagcaggttttctcctccaccccatcaggtgctccaatgttcgtattacacggcgactgggcaatgaaaaatcaacctcaatagtgagcgcttcgcgattaaaaccatcaataatattgagcaaacgcactgaacggccatctgacaactgatcatgcataaaatccattgaccaactttcattaggtacatcaggcactttcaaaggttcgggttgttcgcgtttcaaccgtttcctaggggctgttgacgttttgtgaagggaatttgaacagcatgatgattgggtataatcgttttcgccaaaaaataaccagacttcaccatcatgccgcgaactatgttaacagatacacaatgggataagctatctgcattcatgcaacacactggacttatttaccacaaaacaaaacatcgccaaacatttgaaggcattctttatcgtatgagaacaggcattccgtggcgcgacctgccttccgaattcgggaaagggaatagtgtttttcagcgttttaatgcctggtcaaaaaagggtgttttgcatttaattttcaactagttatctggactctctgatacagaatggttgttcattgacggaagtattgttcgagcccatcagcatagtgcaggagcggcgtctgaagaggatgaggcaatgggtcaaagtcgtggaggacgttgaaccaaaatccatttggctgtagacagttacggtttacctgttcatttcgaactgtctgggggtcaggtcaatgatattgttcatgcggaaagttttgtatctcagtcacctttatcagattttgtgattgctgataagggatatgatagtcagcgtttgagaagtgttatcgaagaacaaaagtcggttccggtgatcccttatcgcaaaaatagccgaaaattggatcaaaaaattgacaaatgtttatatcgttaccgacatttggtggagaatgcctttgccagaatcaaacattttcgtgcgatagcaacaaaatacgacaaacttgaacggaattacgccagcatgctggcactggcgtttattattgtctggttgtcaatgtgggctgaataaatgatgaacacaaaacgtcaacagcccctaaataacattccaaaatagtgctacactttgtacaacgtaagccctttgtattaaaatggttgaaggcactatgtgtagcagcattatgaaatcctatttaggtttaatgcgtttattcagggccagttcacaataaatccggtaaacccgtttatggttccactgaaaccctttcacattatgtaaatacaagtagcaaaacccaaattcccaattacactgttgtcccgtgatattcagtaaccacgccgaaatctgctcattttcggcagacaaacggcataatgtcccaaagtggtattctgatgccgaatcactggttaatgatcctgaaattgatgcgatatacattgcgacaccgccctcgacacacaaagaatatactctattggccgcacaatccggaaaaatagtgtatgttgaaaaacccatggcgctgacctttgaagaatgtaatgaaatgatcgctgcctgccaatctcagaatgtgccactgtttgtcgcttattatcgaagggcactaccaagattaagaattaattgattctggtgccattggtactccgcgcattgtaaattgccaactcttcagagaaatggaatctcgctaccaagatcctgataatttaccctggttcgtaaaaccagaaatatccggtggtgggttatttgttgatttagcctgccatacacttgatatattagattttctgttgggaaaaatcatttcggtcaaagggcatgccaattcacaggcaaaagcctatccggcggaagattgtgtctcaatgtcatttatgtttgaaaaccatatccaaggcgttggtatatggaattttgccgctggcacccgtgaagataaggttgaaattatcggcacgaaaggcaaaatagcgtttgcgacattcggtgatgcagctatttcatattatgacgaaaataatcagctgcaccaattccattttgaaaatcccaaacatattcagatgccatttattcaaacggttatacatcaattacagcgcaataatatcagttcatccaatggggaagccgccgcaagaaccagttgggttattgatgaagtcctaaaagagtatcgaactgccctatacatagaaaacaaagaacaataacccgtcaggccagcattggctggccaaagtaatatcattgccccaagattaagtcgttttgttatttcaccatattgatggtcagagttaatttaataattaaaaatggttcatcgcactttgccgggagacgcggcacgaatcctcagaaagaagtaatccgtgtcgcggtatccgtaagccatccgcttaatgacttttatccgatggttcatgccctctattgtccgactgcgaactacccattccccgtggcacaagagcatcatgctcttcactgctaatatcgcgtctgttggaattaaagcaggacagacaaagcgctgctgttgctaagattaggcaataagcgataatcggccaggcagtagcgctggataaaagtgtaatggcaagcgttccgctcccccctaacagtagcccccccaagcagaagtaaactgctgtagccgtcccagccatatgatcgaaacctcgaagcgcaccattaggcgccacagaaaccgcagtagcgatacccacaccgacaagccacattgggacgataaagccaaataccgatttaggtataagtgtctctccaacagccagcagcagtgctcctgccatcaggcagcacattcccgcccgtaacatgttcaggcttccccaccggacaaccagacctcccacgatccgcgaagtcaccatcatagcgatagccactgttgcaaataacaagctgaaggtaagctgcgataacccttgtcggcccatcattaaccagggggcagtcgaaagaaagacgaagaagctacccattcctgcgctgtagcaaagcgtgtacagccagaaattcaggcgttttacaggaagaagtaactgcgaccactgcaagtctgacttccgttgccatcgggtctctggccagagttgccaggcggcaataacagctactgtcattgcgcctcctagcaaaccaaagattgcgcgccaccccagccaggtgtcaaccaacactcctagcagtgggcctactgccggaaccatagcaagcatagagctgagcaagccatagatgatgttgctttcctcacggcccgaatagatgtcgcgtatagtcgcgaaagtggctacgagacatgccgaagcaccgcaggcttgaataacccggaagctcagaaaaacttctggtgatgaagcgacggtgaggccgaatgaagccacaatgtaagcaatcccaccactaagtaaaacaggacggcgaccaagccaatctgacagcgggccgaatagaagctgaccggctcctaacagaaccaggtatgccgtcaacgttagctggatcgtccctgctccggcaccaagtacaccggctatgaaaggcactaccggcagatacatatccatgcccagtgatgccagtaaatcgaatggtgataacagtaatattgtggcggtaagagaatatcgccaagaaaaatcttttgagtgcacgagcccatctcctcaagtgaaggatttggcggtactctcgtagaacgatgtggttcttgagaacaccgcaacaaccgaaaaactatggctgccgcggcttatttctctgctttctcggtagtgctcatatgcgagttatctcatgaatgaatccatatcgtaacaatcttcacactaagatgcgaagaaccttaacaatatcatccctgtattaatcacacgattatgttatgagtagatcacataatgatgaaatttatcctatgatgtcatctgattctggaataaaaatatttttttagcaagggtttgaaaaacattaatgttaaaaatgacaacagtagaaataaaaaaatatcaactatcagaatattattctgatagtaaaatagactgttaatttattacagagtaattgccatcaatttattgatttcgttatatccttctctttcataaaaacgaatggcttcaacattgtgcgacaagactgtcaattccagatgcgaataattattttcctgcgcccattttttcattccaaccaacagtcgctggccaattccttggcttctggcatcctgactgacgatcaaatcaaaaatataaccataatttcgtggtatcaaacaattaaacggcggtgtattttgctcttgcgcaatggaaaaaaccgccgggtagtgccacaaaatcctctgccagttcaatcattactttttgattatacgttacacaactgataatacagttgagttgcacctgtttcgctgcgaagatggcagccctaaataacatgttgtaaccgaggttttctgtaaatgtctctttccaaacaccgggcggcttcttttccactgcttcctgtcgttttattattactttcaatgacatcaattcaagcgggtgcttcactggccaaaacagtatttcatgtcattggcgcacctggtgtcaccgccctgagactggcgttggggacgattattttatttctgatttttaaaccttggcgtctgaaattccagcgagagtctcttattcctctttttgcctatggcatttcattgggcgcaatgaattatctgttttacatggcattgtcccgtattcctcttggtgttgctgttgcgcttgaatttacggggcctttagctgttgctatgttctcttcccgacgcccgctggatttcctttggatcgccttggtcattgcaggattaggttttctgttaccggtcggagatggcgtcagcacacttgatcctatcggagtcttatatgcattgggagccggtgttttctgggcactctacattattttcgggcaacgtgctggtgctggctacggtgctgcaacggtttccattggatcatcgattgccgccatgatttttttccctgtgggattgatacaaactggcccagagttactgtttgatccctcattgctgcctattgcactagggatcgccattttatctaccgcatttccctatacactggaaatgattgccctcacccgattacctgccaaaacgtttgggacattgatgagccttgagcctgccttgggagcattatcgggaattatcttcctgaatgagcatttgacgatgactcagtggattgccctgttctgtattattttcgcttcaataggctctacctcaaccattaagcggaaggctaaaatagaaaaagtagaataatcaattagtcataaacaagctgaagttatccagaaaaaccggagagtttcgaaactctccggtttttctattattgaaatatgaagggtatatcaactatcaatgtaatagaaacaagcaatatgactcccggagagttatcaactaatcttatttcatccaatgagataactcattattcggcattaagggaacatcattatgagtacagcaaaattaatcagccccaacacttcccacctgatttatacccgcaacaacattaatgaagatgtaaagcagagatcgattactgccctgaatcatatggtgatccactttatcgacctctccatgatgactaaacaagcccattggaacatgcgtggcagaaactttattgccatccatgagatgcttgatggtttccgcactgctctcactgatcaccttgatacattcgcagaacgtgcggttcaattgggtggcaccgcgctaggaacggttcaggaggttcacagccgaacccggctggaaaattacccaacgggcatccatgatgtgcaggatcacttaaaagcactggcagaccgctacgccgttgttgcaaatgatatccgtcaggcgattgttgatgcagaggatgaagatacggcggatatgtttaccgcagcttcccgtgatctcgacaaatttttatggtttatcgaagcaaatattgagcaatgaaataaaaatattatttttcatcatcttatggccgcatctgcggcctttctacatcacggataatctccaataagaaaaaacatcgaaaaatagccgctacaatgtcaaagattagactaacctttaaaaaaatcatttttctctctataatctctttttgatttaaaaatcaacatgaggacgctatacgatggataccgaagtcaaagattctaacggcgcattattaaatgatggtgacaccgttcaagttatcaaagatctgaaagtcaaaggtacttctaagacgctgaaacgcggcacattgatcaaaaacattcgtctgactcaccgtgaagatgaagttgaatgtaattcggataaaatcaaagggttagtgcttaaaacctgtttcttgaagaaaattgggtaaatagcagttacaaaccgatttttgcttaaaagataaataatattaatttttatattatttatctttttttataaaaagtttggaataaaatggaatatttttccaattttcaacgaatatcagaaaaataattcttacaattcataatataaccccgctttagaataccttctcaacaagtatcaagtatcaagtatcaagtatcaagtatcaagtatcaagtatcaagtatcaagtatcaagtatcaagtatcaagtatcaagtatcaagtatcaagtatcaagtatcaagtatcaagtatcaagtatcaagtatcaagtatcaagtatcaagtatcaagtatcaagtatcaagtatcatcatacaaatgtactatcagccttcttttttaatacattaactcactaacgattatttatattttctgaagcaaattaaatagtaaaaattcactacaatcattgataattacatcacgtataaccagactgtgtttctttgtttacttcgaatcaattacacacttaataacgaaaaaaattcaagttattataaactttaattttagttaaaaaacaaaattatgtttgagattacaataaattatatggaaacatcctactaatattttacaatgattcactataatcattataatttaaacctatcttatcgatagctcaccgctatattcaacaaaacctaaacaacatttattatataaaaaaacacattggcatagaagaagcaaagaatagaattaccattgttagcaagcatgctaatataaattaaatctgatattttatttaatatcaaataggagtcaaaaaatggaaattgaatttattgaagaatctgaatcatctgtagaagttctttgcaatagtcttggatgtccataataaaatatattaccccccttattacaggggggtaaattaggtgttcatcatgaatataaaagaaataaacatttatttatctaaattgatatcaaatcctaaatattccataaaaatgtatgaaaaccctaataagttcatggagatatatcacatatctcagtctagccgaggtattttaatagatttttttaggcgaaatggtagtaagtttgttaactcttcaatcttacaaaaaacaaaaagaatggatggattaataatgtcactaccaaatttatacaactatttgaataaagataattttgaattagaatttgaaaaataccttataaatattgacttcaataatgaagtaaaaaagaaccctattattgaatctaagtaatcaagaaaaattaattgcaaatttagcaccataaccttccaatagagtatttagctcatactccacggtatcctgagtccaagtgataaagcgtcgccagtgatatttggcttgtttccagatgatttcaatcagattcagctctgggctgtaggcaggaagataaaataaaagcaggttgtgttctcgtaaccagcgatttctgatttttttctctatcccatgatggatacgcgcattatccaacactaaaaatgtcaggcggttgtccccttgtttggcgacctgctctaaaaaatcaatcacatcagctcgtgtgatactgcctgacggtgcctggtaaaacagcgtgttgtccgtgtaatttaacgcccccagaactgaccgtctgtcatggtgttgaggctcagtttcatggggtttaccccgtggactccatccatattgcaccggcggagaggcggcaaaaccggcttcatcaaaatagaccagacggtagcggcctgcccgtgcaccggccttaatcttatccagcaagacggattttttagcgaactccgtttcatcgcgttttttttaacgacagacgggctcgtttataggtgagcccctgttttttcagtgtctttgccagcgtttcaagcgtgcatggcaaaggaccgtgcttttcctcaacccccagagctattcgggccagcgtcagggattcggaacaggcgatttcaaccgcggttgcgatcatttcaggcgtcatggcgagataccggccgccggcatgaccgcccaatagaccggcaatcccgaagtcatgccaagtgtgaacccagttataaataacccggacactgcatcctgtctcaacggcgatctggcgcggttttaatcctctggccagcatgagtaaaccggttcctctcgtacggatgtcccgatgctgatgattcagggcgagttgttgcaacgtgattcgttcaggctcagaaaggactatcttcgatttcattagtggacgcggtaagtcagtgtattgtattaccgactataacaaaagtgcagataatttcattgattaacttactttcttttgtgaacatataattcaaaagactggagatgaccttttgagaactattgccttatatgaaaaagaaaaaaataatctattaatagatttacaagaaaaaacattcaatatagaagtggaattatcaaaggatattaaatatgatgctatagaaaaaatatttattgtttctaatccaactataagaattaaagagtttgatacaaatatcaaatcactattatcattaatagaaaaagaaaacttcagagaagaattaaataaaaaaatggaaaaagtgaaaacaaacattgtattttacagaagagatagaactagaaaaataacttcattatccatagggaacataataaattacattatattaacatgcaaaacacctatttcagcatgtaaattatttgaaaaaataaataaacaatatattttggatagataatcatttagtaaaactctaaaaattcttagttcgaaaaatttaatctcacttagtaataaaggtgataacatatgagtaaatatggaaaattcggtattggcgttaattataaatcatcattttctaaagaaatttataataatcttcaatatattgatattcttgaagttcattctgagaaattttttttagatgaagaggataattatctagaaaaatgttgtgaagagattccaattatatttcatggtcttgatatgtcattaggaactgatgataacttagatactgaatacttagaaaatctaaaaaatgtcataatcaacaaaaaaccaatgtggtatagtgatcatttatccgctacacgacatggaaatattgaggtaggacatcttatgccaattcaattttctattgaaaattcgtataacatcataaataaaataaaaaaataaaatcagaagtaaatgaaaattttattattgaaaatataacatattattataatatgccaggttctgatatggctgagatagattttatcaatagtatagttaaaaatagtgactgtggaatattgctagacattaataacttatatattaatgcaatgaatcataattacgaccctgaagaatttcttcttaaattaccattaaatcatattgttgaaatacatttagcaggcggttcgtataagtttgatatgattgtggatactcatgcaaataaaatatgggatgatgtatggaagttatatgaatattctctttctaaaaccgatgtttgtggcgtgattattgaaagagattctaatatagagaattatactaccgttatcgatgaagttactattgctcgtgagatttataaaaaaacatataggaaacactcatgaatacattaactaataatgaaaatttaaaaatagcatcattagcaagcatcccaaaaagaaaaaacaatctatactacactgttaaatcaattttttcacaaattgacgaattaaatgtatacttaaacggatacaaatccattcctgatttcttaataaaagataaaataaatatatatatgagttccaagtcaggcgatttcggagatgcatctaaattttaccctttgaaagacaaaataggatatttattcacattagatgatgatttaatttatcctaaagattatataaagaaacttgtatctaaaatagatatgtataacagaaaaaatttcatttgcgtacatggaaatatcatagatagaacctcattatcatcgtattatgataataaaaaaggaatacattttctaaaatcacttgataacgatatttttgtaaacattccaggaactggtactttagcttatcattcatctcttcattctttttctatgaaatcatttccaataaaaaacatgtctgatatatgggttgcagttattgccaaaagaaataatataaaaatagttgctattaataggaaaaaatattggattcgcacatcaataaaaaataaagatccttactccatatatagcaataagaataaactagatcaaataatatgccaaataataaaaagagaggaattatataacatatgaacaatgaatataaaatcaccctgaacaaaaatgggtatattctgataaaaaattttctatgtgatgaagaaaaaaaatctctaaatattgatattgaatttctttataataaaaaagatatcccaggaaagatcatgaaatattacgaagaaagtgttattgatagtaaaaaaatactcaacagaatagaaaatttcattgattataaagaaatagatcatataaataaaatagaaaaaaagtatctaaattactatcaataataacagaaaaaaaacatattctctttaaggataaaattaattttaaattgagtggtggtggtggatttcttccacatcaagatcatccagcgtttactagatttattaaagaagaaatatttaacattatgatctcagttgatgatatgaatatagcaaatggttgcctatatatttcaaaaattccatttaaaaagaaatcgatccctcataatagtggacaagcattaaaaagctcatataaaaa

SEQ ID NO: 16895 - DNA, 318465 bp, Xenorhabdus bovienii
  unsure (1)..(318465): unsure at all n locations
ataccggtgagaaagatatcccccacgttcttgatggaagccgggaataaaattaatgcccgggcaattagtcagattgctgaatatcccgatggaaagggcgaaaaccttgcacggttcagaaaatggtaaggcgcatgcggatgctttaaagcggggctgtcgtgaacattatggtgcggcagggcgggaatggatcggttatctatcgtcacaccatgaggaagccagacaggcttatattgaggcgcaatcacggtggggcaagctaataccggaaagttatggtgagcaggtacaaagggtcagcgaccgctttgccgtactggaggcggctttaatgttggggcgggtcattacgggctggaaagcgcaggattgccgcgatgtgttgcaatatatctttaatgtctgggtggcggagtttgggactggcaataaagaatttgaacagattgtcgagcaggccgtttcctttcttaacgcccatggcatgagccgctatgcccctctgccctatgatgagcgggacttaccgattcgggatttagccggataccgggaaaagaaaggccttcatgataatgatccgatgattttctataccttacccgccacttttaagcaggagatcgcccggggttttaacgtggatatgttcgcagacacgttagtgaaaagcgacatcctcaaaaagccggccagtggaaggagctatcagggcaagacaccccgccttaagcatttggggggtattcagcaacgggcttacatcatggtgttggtgcctgaatcagacgaagaagcctgatcttctcatgtgagagctaaaacctgttgtctcagttgtctcggttgtctcatttttattaactatatgaattttaattattttagtttttaaattgagacaacatgagacaacaaacaagggttttgagacaacatcaaacgggtaaaagttttctttttggcaggccattggaggcattatgagaaaattacgtaaattataccgtcagaaaatcaatggctttacgggcatgctgttggaacttcgcaccttgtccgaagagcggttccatgatcgtgagctgaccgacaaaattattcttaatctggtgggggagtgtgctgatgcgtgatattcagatggtacttaaccaatggggtgcatgggccagtgaagggaatagtgacgttgactgggcacctattgcagcagggtttaaagggctggttcccagtacccgaaagactcgcgctcaatgttgtgatgatgacggttttgcgattgatgctgccgttctgcgattgaagaaatataacccttattatttccagctaatcgtcatgcactatattaaggcgtctgcacttcgggcaatggggacaaagctaggcatctcccataacgaagtatcaaaacgattacaggcagcagagggatttattgaaggcgttctggcggtatcaggggtcactttggagctggataaatgcgtacaaaaagaaatcatcaatagggttgcgtaattacaaaagtcagtatattgtgataagagtgatagcaatgtcacacagcttatcgatttaacaagcctcgcccagtgcgaggtttttcatttaaaggagttcgttagtggatgttatagatttagccgaagcgttcgagcaccaaatcgaaaagagagtgaaaaagattaaccttgatagagagtttaaagatgagctcttttttacttcaggttatgacaaatcggttgtttacaaagaccctggcactcagcttctctgggaaatatttgttgcaggtttagaaaaagggcaaaaatcagcaagaattaggttgcctcaatcaaaagaaaacccagataacttttatgatgctggttataacgaaggcataaaagattgtagaaagcatctgcaagcacaaaaaataaaagttatataatacgcccagtacagtttttttgtttttgagagaaggcaaacttcatcatcataattattgcttctctgatgattattaataggctttaataacttccttttatctgagttaagttgtcagtattacccttattttaatatgaggaatttagatgttgtgcaggtaatatctaagtgatgcctgaaaaggttaattcatataaataaggggattattatgataaacaaaaaagtgagtattcttgcaggactgcttttacccttgattgctgggacggggatggctgctgagaaagcaacaaccgggcaaggggttattgctccgagtaattttcagtgtgataaattcatgtcatccggttattacatgggaaaattggattatgtgatatcgatagataatttgaacagcacctattattggtttgtaagttcggagcaagataatcaaacaggatgtgttaacgttgacgaatcaaaggtgaagcatgctaaaattattcatgatgcttttcttcaaggaaaaatcgtaaaaattagactgaatggatccgttatagaaaggatatcattttgattgcactatagcctcgcactcgcggggcttcttgcaacggtaaggttacttttgaatgagttaccttaccgttgtggagaatgccaaggctgattggcagcttagatacctacatcttaattgccccctgaaagactgaccaataatcactacggtgtgcgggatggggaactgggcgacgtaatgcaggggatcagcgcctgcctccacaactcgatcatggtcggtcaacacctacatcacttttaaatcaataggttaaatgtgattttaggtgatacggtcaacacctcgatccccatagataactcaacctgttggcgagaccaactagttcaaattcaaggctgcactccggcgtggcctttttcatatctggaactttggcgtagagggttcgcgcggatgcctgaagagcattaggactcggttcgattccgagaggttccaccaaattatcgaaggtcacttaggtggccttttttattacctacgcaatgaggaaattaaccatgtacgcattaaagctaatcacagaaagaaacggtcgttcagtagaagagtcatggatcttgggggacatgtaccgtctggagttttgcccgaaagatgtcgctgataatgttattgcccgtgtcgagcatagccagaacggtaatctgattaatcacgacatcaaaaaaacagaccaagcctacattaccactctgacgggtgacactgttcgcacggtctgtcgaggtcgatcagtaagtcaggccgcatgatcaatacagagcgtctatatctgggcgctcgatattgattattacctaattatgccgctgcaatcactctcagtacctccgtatctcctattgcggtcagcattctattaaccaactcacaggggcgaccatagctcaccccacggacgcccattgttcaaatggggtggaatatgaagatgaaagagaatcctgatgtatgggctgaactgctcaatggtctgcaaaattcgtggccgcagatatccggctctgctttggcaatagctatttgttacggtcgcctgatttatgacggcgtagaacgcaagaaccgatgggtcgaagcgctgctttgtggtgccttgtcatggagcgtgtccagtggcttagagatgtttggcgttcccagcagttttgcgcccgcaatcggtggtgtcattggttttattggcgttgaaaaaatacgtgagtttgctatccgcgccatcaataaacggttgggagataaataatgaccagaggcattcgtaataacaatcccggcaacattgaccacaactcagcgaataagtggcagggtcaattgctccatgacccgagtatagaaaagcggttctgtcggtttgagtctgctgagtatgggattcgggcattattcaaattgctgagaaattaccagaacaagcaccaattgcattcgattagaaaaatcatcaatcgttatgcgccacctgttgagaacaatacggaaagctacatccagttcgcggctgaaaaggtcggtgtttctgctgatgagaagatatcaactcaggataaaaaagtcctgtttgcgttggcagaaggcattatcaagatggagaacagcaatcagcaaccctattcagaagagacgttagaacgggcatttaatttactctgaatcctgagcctcgcaatcgcggggcttctttttatctgcgtactgacgtgcgcgaaatccaatcatgagcttatagaaatagagcctgagagatatcgctgggtggcgacctttcatgggcgatatttctacgtcagcaggctcttatttctataggaatacgcaatatgcacacaatcacagtccccttttatgatgatgaactttatgtcgtggaatacaacaatgaaccgtatgtgccgatgaggcctattgttgaaggaatggggatgaactgggcttcacaatacaccaagataaaacaaagatttaacacctgtgttgtgaatatcacaatgcagcttcccggagataaacagcatagggatgtagtttgccttgctctgcgtaaacttgttggctggttagcaaccatcagtccaaataaagttaaatccggcattaaagacaatgtgatccgctatcaaaatgagtgtgatgacgttctttatgactactggacaaagggtatagcggttaatccccgcaagcgtagcgtgatggaagaactgaatcaggcctgcgctgacttaaaaagagataagcagctagccagtgtatttggtacgggtcttaacgaatggaagaaggttaggcctgagcatgaaagcaagataaataagctggtagggcaggctacggatttactgctggattttgttttagctgagacaggcaaaggcaaaacaacacgcactcaataaggtgggtgatatgaaaatgtcagatacaacatttgttttgatatgtacattaatcggctggggctggtttttcttagcggtgatgttgctatgaagttcaacagccagcacttcactctcggcgctctggtgattatctcgggtctgctctggttctattacagtgagtatcgggagaaagataaagcctacacggaactggatacgaagtataagaatcagcaggccatcaccgacaacgcctttcagtccatcaggatcatcaatgatatctcacgaattaatcgcgaaagccgggatcggtcagccgtggattctgagcaagctaaaacggccatcaaaacggttgttgccaataatgattgcgccaatcgccttgtgcctgatggggctgttatccggttgcagcagcacacgaaccgaatacgttccggtgccaccgatacctattccggcacatctgctcgctgattgtctgcctccggtcattcccgacacaatgacatggagtgacagtctcatactgaatgaacagttactgacggtgattgagcagtgcaatctggataagcaggcaatacgggaaatagaagaaaagggtaaataacgatgaatggattatccaaaggtgagtacaaaaccaatcggaaaatgcataaccggatattcaaatatcgccaattgaaattttatcaatactcaaaggtagctgtcggagacaccactaccttgaatatttacgtgtacaaatggttcattgtattaattgccattccaatgctgctctacggttcatttgtgattggttttataccgacattcaaggagctgattgatctatgggaagagcctgtatcattcgatagtttgcgtcaaatccctgatggactattgaattagaaaacaccttgccaccgcagagcaaatgattctggggttgccggagtatgttaggacgcagtgtcaataaacagatcatcgagggaaataatgaatagcccagaaattagattgagttatcgttccagtataaaagatctgagtataactattttacatgctatattttttcctttgtatgccgcgtggcgctggtggaaattacatatggctagtaagaaagaaatactggatgatttatctagatatagagagaaaagcgataaattagcggaaaatgtatactctatttcaatgaaatcattggaaattcttagtgaggttgagcgtcttttaaaacagggcggcgaacatcaagaactcatcactcagatacatgaatttagcgaaattgttcttttaagcagcaatgatacttatgaatattcaagctcattgatgaaagactacatcccagcgataaaaaaaataagcaatagctctgaagattaaggggttacgatgccgagtttactttctgaaattcaacaaaaaataaataaatcaaatgagctttatagtgtaaataaaaaagcggtagcttcagaggaattggagttaaaagaaaaaagggaacaagacgacaaagcccgtcatagcctcactttccattttgtttggggattttttggcctgattgttggctgctttctgtttgtgctttggtataacagtcatgctattgattggataaaaacactaaatactcaaggactatctgatgccgccgcctcagtcaaattgttagagctggataaagtattatctgtaattatcggcgccctcggcacatcacttggttttataattggttattactttaaagagaagaaaggctgacggcctgttcctgcgggttttttctctttaaagctgcttaactacaaaaaataaatgcaaccacctccgggtggttttttattcccttacccattcccctgagtggttaaaggaatgccccatgccatcagttaacgcgggtggcatttttgtatctgagttccgcgcactcaccgcgcatatcaataaaacgcagccttacagaaagtcgaacctgagaaatccgttaatgggtatttctgcgggcggctttctacgtgagcaggttcgattttctataaggaaatacccgatgagtaacatcattccatttgagtatgacggtcaccctattcgctttaatgaagaggggtggatcaatgccactgatatagcaatgaagtttgataaggagccgacagcatggcttcgtcaaattgatgttctggaatatatatccgctcttagttttcgtgtatttggtatttctggcactgtgccagagattaacgaaatcaagaggttagcaataagttcaggtgcagctagagccaagatactgagatttgctaaaaagagcggacttgtgaaagtgaaaagtggtccaactggaggcacatggttacatccaaaactcgccatccgttttgctcgctggttgtctgttgacttcgaaatttggtgtgatgaacaaatagatgtattgatccgtggtatccaacccacattcactgaccaacgcatcaatgccatttttcttcttgataagcccgccacatgggaaaagcgttttcagcagcccttttatcaggcactcagccgtatgtcaggtttgccttataagggtcatgttggcggcaccccgtcactgtttgggatgatcacatccaagtgggtgtatcaggttgtgttgcctgactcggtatatgcggaggcaaaagaagcagccaaaagtagcggggacaagatccatcaataccttaaaccggaagcccggaaactggtacaggagcaactgaaagcggtcacgatactggctaacggctgcgtggattacaaagactttgaggctcgttgtgttcagtcatttggaaaatcaggtgagcaaggtttgctgattttaccaatagaaagggaattcagttactcagcggtcagacattagttcctttgcgtcgggttatcgccgtctgtctgtattagccatgacatgttccctttgcatcgagcgtacaggtcagaatcaaaaataatcaatgccctagacagtcattatcagcaacatccgctgtaggcagaagaagcggtgtgacagccggagagacggcctgcattgccatcatgattcacagagtcgtgatcgccatgtagtcaaagaacccaagtccgataatcggatattgcccatgtttagggcacttgcaaggacttttatataaatcagaccagttatttattttgaatgagggtaaaacacgatggaaattcgtattaatgaagatggtagtgccagggtaacgacggcgggatacatagcattttacgataaggaaggaagacttaagatggtaattggtcgtcttgtacacacaacgggagaacttgatcctgtacctcaaagactcaccgatatcttacccgtaaagctcatcactgagttagttttcaagcagaaagcagaaaaggaacaggcgagtaaaacctatgacgcaggtatgacactggcagtagatacaggtaataaggctggaattaccagtgatagcttcaaggccttcgatgtagccggaaatgtttacgtgaaagaggcgggcattgatgccaaggcaatcagagcaagccatgacgatcacatccgccagatagtccgtgaagagatacgccagttcgtcaatcgtgagagcagaggcaatggtttattctcaaggcggtgacgctatgtctcaaccccgtatctatggtagcaaatggaacaaggcacggctggccttcctacaacaacatcccttatgtgtcatgtgtcaccagcaagggagagtgaccggcgcgaccgttgttgaccacatcatcccgcataagctgaaaggggcactggattccggtaacaagccggagatagccaaagcacagaagctattctgggataccaagaactggcagcccttatgtgacagtcaccataactccactaagcaacggatggagaagcgcggtaaggtggtcggttgcgatattaacggcctgccattagatccccattcccactggaattaataagatgaccgaagacgaacaaaccttactgatgttcaaaggcttgatggcctctctgaacgagcagcaacagaggcacgtcgataactgcctgaacacgatacgccaactgatggatgactacccagaaggtgaggcactgattgcattgggttatatcggggcagaacagcaaatgaaaggcaactggggacaaggtgaaacggttgaccgataaaatgatttcactgggaatgatgacgcaggggcgggataaaagttcaggatgatgaccccggcagaccggcgccagccctcaaaaataacgctaacccgatttttttcgtttaaccggagtccattatggccgaaaaacgggatcgctcagacagtgtgagcgccgaaattcaagccatgaaaaacgcggccgctgacaccatcgaaccgcctatccacgcgggtctagagaaaaaagcggagcctttctggcatgacaatatccgctctaaagccctcgatagctggacgccttccgatctgctggcggcggtcgaattagccaataatcagctcgaaatcacgctgttacgcaaagaattacgcaaaaaagagcgggttcagggggaagggcgggacgaagatgtcattaaaactttacgtaagcagattgtggaattgcagcgcaccatcctggcgcaacgccgtgatctgcaaatccattcccacgccaccaatggcgaaagccgtgaccagcgtaaacgtaatcagaacgatgccgaggcacggcgcgtacgcgatgaaatgcagggggatgatttgctggcctccccggtacattaaggagaaaacctcatgacacgcggtgaacgtgttattgcgtttattgaacgctattgcattgtgccggaaggcgagcttatcggtcagcccatgcggttagatgcgtttcagcagaaattcttactggagacctacgataatccggtcgggacagataaagcctatctcagcattgcccgtaagaacggcaagaccggactgattgccgggattctactggcgcatctggtgggtcccgaagctctccagaatacccagattgtcagcggggcgatgagccgtgagcaggcggggattgtgttcaatctggcggtgaagatggtgaacctcaaccctaagctgcaagagatagtccatattatccccagcggcaagaagctgatcggcaaaccccggaacgtggaatacaaagcgctggcggcggaaggcaaaaccacgcacggtttgtcaccggtactggcgatcctggatgaagtcggccagattgttggtccccgcagtgattttgttgatgccatcattacttctcagggggcgcacaagtcacctttgctgattgccatcagtacacaagcggcgaatgatgccgatttactcagtctctggctggacgatgcgaagcattcccatgacccgcacattgtctcccatgtgtatgaggccgacaaagaggcggacatccttgatcctgccgcgtggcaagcggccaaccccgcactgggtaactttcgctcgttaaaggacatgcagcggctggcagaaatggcttcccgcatgccgagtcaggaaaacatgttccgcaacctgaacctgaatcaacgggtgtccatgagttccccgtttatctcacgtaacgtctgggaagccggggcgaaaccgttaaaacctctggtgggacgctgttatgccgggctggacttatccgaatccaaagacctgacggcgctggtgatcatcgggcaatcggaagatggcatgtggaatgtgcatccttatttctggacaccgaaaaagaccctgcttgaccgggcgaaaacggaccgggtgccgtatgacgtgtgggaaaaacagggcttcctgcgtaccacaccggggtcgatggtggactatgacttcgtggtgcaagacatcgcggagattatcggtgactttgctattgaggtgatcacctttgaccgctggcgtattgatatctttaagaaagccgccgaacacatcggcctgacactccccctggtggagttcgggcagggctataaagacatggcgccggcactggataaaatggagcagcttttgctgaacggacaggttaaccacggcaatcatccggtgatgaacatgtgtgccgccaatgccattacggtcaaggacgcggcatccaaccgcaagctcgcgaaggacaagtcgaccgggcggatggatggcatggtggcctttgcgatggcggttggtgcctcgcatgagatggaaaccgaacagggggatattgacggcttttttgatgacccgattattgtggggatttagatgaaaacagaaaaacaacccggacgtgtcaagtcggccctgctgaactggctgggggtacccctcagtctgacgaacggcaccttctggcaggaatggatcggcaccagcagcagcggcaaggtggtgacggcggacaaggcgatgcagctttcggcggtctgggcttgcgtccggttattgagtgaatccatttctacgctgcccttaaagatttatcgcaccaaaacgaatggttcccgtgaattagccaaagatcatccggtttatcgcgtcctttgccgacaacccaatgccgaaatgaccccatcgcgctttatgctgatgatagtggccagcctgtgcctgcggggcaatgcgtttgtcgagaagcgctatattggttcaaaattggtcgccctgctgcccttattgccgcaaaacatggtggtcaaacggctggagaatgggcaactggaatacacttacacggaattgaaagggagaaagcgggtcattccccttaagcacatgatgcacattcgcggcttcggtctggatggggtcagcggcttaatcccggttcaggtcggcagggatgtgtttgggacagccatgtccattgatgaggcgaccggcaagatctttgaaaacgggttgcaaagtaccggattcctgtctgccaagaccgccctcgataaggatcagcgggagcggctgaggaagaatttacagcagttcgcggggtcaaaaaatgccggaaaactgatggtgctggagacggacttatcttatcagagtgtgaccatgaatcccgaagccgcccagatgctggagagccgcacttttagcacggaggagatttgtcgctggttccgggtgccgccgtttatggtgggtcacattaccaaacaaagtagctggggcgccagtgtggaagggatgaacatgcagttcctgaccaacaccctgcgcccgttactgatcaatatcgagcaggaaatcagccgctgtctgctcaatgacgatgaagatttctatgccgagttctcggtggaaggtctgctccgtgcagacagcgccggacgctcggcttactacaccacggctttgcaaaatggctggatgagccgcaatgatgtgcgccggctggaaaacctgcccccgattgacggcggggatatccacaccgtgcagctcaacctgacgccgattgagcaacttggtaaagccggtaacggctcagaatcagaaaaagtccgggcgcagatagttgactggctttttcctgagcgtagcgagccaccgcctacatcctcaaataccaacgtcaagcctcactctgaggagtaattattgatgagtaaaaaacaactgccggtcgcgccggaggggcgcccctgtgcgtcgatttcctgtgagctgaaaccgaaagccctggatagctggcacagtggcatcaaagccgccagtacggataacaccatcgccattttggatgtgatcggtgaagacttctggggcgaaggagtcacggtcaaacgcatttctgccgcgcttcgggcggtcggcggcggggatgtggtggtcaatatcaacagtcccggcggggatatgttcgaaggtctcgccatctacaatgtgttacgcgcctacgaaggtaaggtcactgtcaaagtgttgggcatcgccgcctcagccgcctccattattgcgatggcgggcgatgaaatccagatggggcgcggggccttcctgatgatccataactgctgggcgctgggtatcggtaaccgccatgattttgccaaactcgcccgtgaccttgagccgtttgataacgcgatgggcgatatctaccgcgcccgcagtggtctggacgaaaatactattgttcagatgatggacaacgaaacctatatcggggccagtgaggccatcgacaggggactggctgacagtctgatgtcggcggaggtcattgagtccggcgatgaaagccatcaggccgccttgcgcaaaatcgatgctttattagccaagacgaacacgccccgcgccgagcggcgcaaactgattcaatctttaaccgggagtccgccgggcgcgacccctgaaattaatcctgaaaccttagccgcactgcaacaggccgtgaatgcctttgccccggcacacctataactggagtaacccatgtccgataccaacgaattactgaaaggcctgtccgccaaaatcgaagaggcgaacggcaaatttaatgccaaagcggaagaagcgctgaatgaagccaaaaaagtgggcggattaagtgcggaaaccaaagcggcggtcgataaaatggcgaccgaactgaacgccctgcgcgaatctgaaaagaccctgaaagcgtctctcggtgaactggagcaacatgtggcgcaaatgccgctgcaaaatgccgttcaggcggcgaagaccatcggtcagcaactcatttctgccgaggtgctgaaagatatcaacgccagtattccggccagcaaacgcatttccgttccggtacaggccgcactgacgtcttccggtgtcgctgagggcgtcgttgaaccgcaacgtttgccgggtgtggatgtcgcgcccaagcagcgcctgtttatccgtgatctgatcgcaccgggcaagaccacgtcatccgctatcttctgggtgcagcaaaccggatttaccaacaaggcggcagtggtgccggaaaataccgccaagccgtacagtgatatccagttcgagaccaaaatcacagccgtgaccaccgtggcgcatatgttcaaggcgtcaaagcaaattctggacgacttcgcccagttgcagtccctggtggatgcggaaatgcgctacggcctgaaatttgtcgaagagcaggaaattttgttcggtgacggctccggtgcacacctgcacggcatcattccgcaggcgtcgaagtttaaggcggaattcaaggtcgataagcaaaacggcattgatgatctgcgtctggcgatgttgcaggctcaactggctcgtttcccggcgtcggcgcatgttctgcactttattgactgggcgagtattgaactcgctaaggattcattaggccgttacattctggggaaccctgccggattgatcggccctacactgtggggcttgcccgttgtggcgacagaagcggcggcgttcaggggcaagttcctgaccggggcattcaatgccggggcgcaaatctttgaccgcgaagaaaccaatgtggtgatttcgaccgagaacaccgacgacttcgagaaaaacatgatttcccttcgttgtgaggagcgtctcgccctggcggtcaaacgtcccgaagccttcgtgtacggtgattttaccgtgcccaaatccggcgaataatcccctgtcaacaaaggcggccttaaccggtcgcttttttattggagcaccgcatgaaactgaccgtactgagagcgatttattttgaggggcaggtgatcacagaaggtcatgtcattgatactgttgaacaacacgggcgcgaattaatccaaaaaggctatgccgccgagacagccgagacgcacactctgacggagccaacggagccaacggagccaacggagccaacggagccggaagataagggggaataatgctttctcttgaactcgtcaaagcacaatgcaaggtcgaataccctgacgatgatgacctgctcaatacctatattggtgcgtcggtgaaatatgtcgagaactacacccgacgctcactgtatcccgataaagaagcgaaagggtatgccgatgaccccgatcacttattgttaaccgccgatgtgcaggccgccatgttattgctgattgcccaatggtatgaaaaccggagtgccgcgtcggtggggcaatccgtgtcttccctgccattttcagtcgcggcgttactgcaaccttaccgcatttacggtttgtaaggagggcaaatgcacattggaaaaatgaggcaccgcattacattgcagaactttaccccggtcagattaccttccggccagaaagtgcaggaatggcaggacatcgccacggtctgggcggaagtgaaacacatcagcgggcgggaattactggcctccggggcggcattgtccgaagcgaccgtacgtatctggctgcgctaccgggcggatgtcaccagtgcgtcacgtctggtattcaaggggcaggtgtacgatattcaggccgtcattcctgatgggaaatgtacccaacttgaactgctgtgcaagcagggggtgagatcatgattgttaccgatctggacttctccgggttacaggagattgcgcgggatttggaaatactgagcaaggccgaaaatagcaaggtattgcggcaggccacttatgccgccgcctcggtattgcgggatgaggccagagtgaaagcgccgaaacgcacgggcaaactgagccggaacattgtggcgtccaaccgcaagagccgcaacggtgacgtgttggcgggggtgtatgtccggggatcgaatgccaaaggcacgaacagcgaccccaaaatgaagaagagcgacccgcgtaacgcgtactactggcgttttctggagtacggcacgtcaaagctggctccgaggccgtttgcccgcccggcctttgatgccaaatccgacgaagcggcaaagtttgccctgaaacggctgaatcaggccattgatgaggtgctgtcgaaatgaccgaggcggatattttccccttactggccccggtgctgcccgatcaggtctttccctatgtcgcgccgcaatcagccccgtccgtctccccgccgtggtgtgtcttctcactctacagcatcgatcaggatgtgctgaacgggcaggctggacaactgaacaacctgcaaattgatgtctatgcactgaccattgatgcagcgcgggagatacgggataaggccagaatagcccttatgccgcttaaaccgacccaactgagtgaaactaacagctacgagtctgacacggggctgtaccgcgccacactggaatgccaaatctggcagtaacaaaccctttttccctgaccgtctgcggacggtttttttatttctggagaatttcccatgagcagcaagtacgaaaaagcccagggcacgaaagtcagcatttcggccacggcggcaaaagaagcgaacccggtcacggccgtctggcaggatattgactgcaccacgaaagaggtcagctacaccggtgggcaaaaaagtgacattgaggtcacgacactgtgttccaccgagcaggaaatgaccaacggtttggccgcaccgggcgaaattaccctgtccggtaactggtcagccgacgaagccgggcagaacaccctgcgcaacgcttacgacaccgatgaattgcatgcgtttaaggtgcagttcccgacaggcaacggctatgcctttttagccgaagtgcggcagaactcatggagcgtgtcggccagtggcctagtgaccgcttcatttaccctgcgactgaaaggcaaacccgtccccctcaagcaagcggctacgttaactaaagacacttcacaaggataaatcacatggcaaaggcaaagaaagatttacggtctctggcactggcacccggcgccggatttcgcagtaaaaccgtcaccgtaccggaatggggtgatgttgccgtgatcctgcgcgaaccctctgcgggggcgtgggcactctggcaggcggttatttcccctaccgaggacgaggaagcgcagccgctgtcggtcgcggaaaagacccgccgcaatgtccggggggatgtggtgctgtttatcgatgtattgtgggatgaagacggtgaacaggtattttctcctgacgatgacgacaccgtggcggggatttacggtcccgtgcatgcccggttgctgcatcaggcgctggatttaatgacctcacaggccgacgcggaaaaaaagtaaaagagcccctgaccttcttcatgatgacactggcgttgcggctcggcaaaaccctgcatgagctgcaacgggacatgagtgccagtgaattgttgtgctggatggcctacgaccggcgcagtcccctcagtgaccgccgtggtgacattcaggccgcccagatagcctcagcggtttatcagtcgcagggcggcaaggtcaaactggaagacaccctgctgcaatggggtgccgatccccagcaggatgagcaggagctgtctgggctggaaggtttcctatccaacttatcgtgagtcattgctatggcaaaactgcgtgaattaatcattaaaatctcggcaaattcggcctcgtttcagtcggaaattgcccgcgcctcccggatgggggcgggttattaccggacgatggaaaagggcggacgtcaggcggcgtctgccagccgtaacagccagcaggcgatgcgggaactgaacggacaactggcctccgtgcgggacacggcaaaaggcatggcgggggcgtttgccgggatgtttgcgaccggacgtctcatcagtatggcggacagttacaactccctgaatgcccgtatcaagctggcgacgacatcaacagaggatttcaaaaacgcccagcaagggttgctgcggattagtcagtataccggctcgacctttgaatccaatgccagcctgtttacccgcgtctccagctctttgcgggaatacggctattcgacaaaagatatcctgtccctgaccgattctttggctactggcctgcaagtgtccggggcgtccgccgaagaaaccgcctcccttatcacccagttatcacaggcgttagggcgcggcgtacttcgggggcaggactttaactcggtcgcccaatcggggcagaggatcatgaaagccctgtctgatgggctgggagtcgcccagaaagacctgaaacaactggcggatgccggggaactgaccacgccgaagattgttccggcattagtcagtcagttggaaaccctgcataaagaatttgattcgatgccgaacagtgtcagcgccgcctcaacccgggtgatgaatgcctttcagcagtgggtcggggaagccaaccagacaacatcggcgacggcaaccttgtccggcgtactggatggggtagcgaaaaacatagataccgttgcggcggcgggcgcgatactggtggctgtcggtgccgcccgtttctttggcgggatgatgtccggggcaaagacagccacggggcggatcctggaaactcgcctcgctgaggtggcactcgcggagacgcaggtcagggggacacagatttccaccgcacgggcacgggcagcggtctaccgggcacaacaggcactggtagccgcaaaaggcaccgacaaacaaacgcaggcagaagaacgcctgtcccgagcacaggcaaccctgaaacgcaatacggatgcccggacagcggcacagaatcggctgaacggcgtgacctcagtcggctcccgattgatgggcggcgcgttggggctgattggcggcatgcccggcttggcaatactggcgggttcggcgctctattttatgcatcaaaagcaggagcaggccaaacaatcagcattggaactcaggaacagcacggaactgctgaccgaatccttaaaggaaatgagttcgctggaagtcaataaacgggtctttgatacgcaggaccaaatcacggctcagaacgaagccatagagaaacaagaaaagttagtggaagcgcgaaaagcggatatggtgcgcatccggatagtggctgaaaaaggcgtcaaaaccctgtattcggcagatccggtgacgcaactgaccgaggcgacccgagtgtataacaatgaagtgaacaatctggcgctcatgcaggaggggttaagcaataagcaaaaagaattaaacctgttgcagttcaggcaaacgggtctgttgcgtgataattatgtggaaatgctcaataccagtgatattctgccgatactcacactggccggctcggacttcaaccggatattgtccgtcggcaatcgtctgttgcaagagcgaacgacgttaacaccggttccgtttgcacttccccagactcccctgagcgacgagcaacaggactttctgaagaagtcggcgcgtgatcttgaactttctgcgttgcagggggccgcgaaggttaaaagacaggcggagtttgccgcagaggatcaaaagctaaataccccgcaatatcagaaccattatcaaaaatacatcaatgattcggtcgccatatatcaaaacggggaaaaagccagagaggcgcaggcggcggccgcaaaagcgaccagtgaagcggcaaaggtcgcgcgtgaagccgccagcgcacaggaaaattaccgcaataaagtggctgacctgaaccgggaaattcaggtcgagcaggtgcgtatgaaagacggtgaaacggcggcggcgctcttcgcctcttcactggatgtcagcgccaaatacaccgggaaacagcgcgaggaactaatccggctcagtcaagccagtattcttgccaaacaacgtacccaagatttacaggatgccattgaatccgacccctatcgtaaagccgccgctgcccgcaaggaagcggaagaacaagtccagcgacagattgccgccaaggatatccagagcgtcgaggagtcagcgcggcgtaaacaggaaattaaccttaattacctgaatgccgtcgccgaagctaaccagcgatatgccgtatctcccagtgccgaattagtcggcaatgttgatccgctacaggatatccaaaatcaactggaaaggcggaaagcgttgattcaaacctacgccacagaaggccttatcaccgaacagcgaaaaaatgagttaattattgctgcggataatgaaactaatgagcgtcgttatgaagccgcgatgcaactgtatgccagtcaaggacggatacagaaaatgacggtagatttgttttctaccacaaaagaacgcatgaccaacatgttaacaggcatgttgaccggcacccagtcattcaaggagggcatgatcggcctgttttcctccctcacacaaagcattatccagaacctgatggatatgacagcggaagctattctgaccagcaataccttgaaatccatcatgggcgtggcgggcgggtttttcggtggcgcgggtggcggagggacaacgctcgctaatggtcaggctgtgcccatgttgccccagaacatttcagtcaatgccaaaggtggtgtctatgattcaccgagtctcagtgcctacagtgggcaggtagttagcacacccaccttctttgcctttgctaagggcgcagggctgatgggggaagcggggccggaggcgattatgccgctcgccagaaccggtaatggcaatttgggcgttaggctggttgggggtaatctgccatcgtcgaatagtgcacccaatattcaggtctatatcacggactcaggcggcagaagtcagacagcaaacggcgcagacgcaggattcggtgaaaatttagcgcgggcatttgcacaggtctattacgctgaacgggataaagatctgcgtccgggcgggacgattaaccgggcaatcagggggcgataatggaaacctttaactggagtccccgaacgagcacctctgcgacggtggactttaaaatcagaaaagccgcgtttggcgatggttacacgcaagtgtcgggggatggcattcatccccgtagtcaaaaatgggcgctggattttgtcggcaatgaaaaatacatccgggcgattctggaatttttagaccgccatcaagggcataagtcttttatctggaagccaccgctttctgacaccgggttgtatcgctgcgaaggttataagaccagcgcactgggtggcaaaaactactcgctgtctgctgaatttgttcaggcttatcactcttaggagaaaacgatgatcagtgctgatgtacagaaactggagccgggtaacgttatccggctctatgaggtcgacggaacggcattcggtgcggatactctgcggttccatgcctacggcataccgcatacccctgccgagattgaggcagcaaaacgtgatcccgacaagttcaagccgaagtctgtctggtggcaaggtgaagaatatggggcgtggcctgtcaagattgaagggctggatatgtccagcgacggacagtctgcacggcctaaattgaaggtcgctaatctggatggcctgattaccgctttgtgtttgcgttttgaggacatggtgcaggccaaagtgaccgttcatgatacctttgttcattatctggatgcggtgaatttccccgaaggcaatccgactgccgatcccgaacaggagcgtaagcaggttttctatgttgaccgcaaggagtctgaaaccgatgaaatggtcacctttgagcttgccagcccggcagatttggaagggcttaaaatcccgacccggcagatacacagcgtatgtacgtggtgctcgcggggctggtatcgcacgggcaagggttgtgattatgccgggagtcgttatttcgatgaaaacgataatccggtcgatgaccccagtaaagataaatgccccgggcgactcaaatcgtgcaagttgcgattcggtgaagatgaacctttgccgttcggggggtttcccggtgctgcattgattaggcggtgactatgcgtgacagtacgctacaagcgatattcgaacacacaaaggctgaataccccaaagaggcctgcggggtgattgcccaaaaaagtcgggtagaaaaatattttccctgccgaaacttagcgcctgacccttccgagcagtttcatcttgatccgcttggttatgctgccgctgacgaatggggcgcgataactgccattgtccatagccaccctgacgcaacaacgcagcccagtgaactggatgctgctcaatgtgatgccaccgaattaccgtggcatatcgtgagctggccggaaggggatttgaggacaatttatccgcgtggtgagctgcccttaacaggcaggccttttgttctcggtatttatgattgctgggggctaatcatgagttactaccgtcaggaacatgctattgaattgcccgattaccgtgttgactatccttggtgggaacagggcgaaaaccggtatatggacaactggcaggcctgtggctttggtgagttcagtgacaccccccagattggcgacgtggtgattatgcaggttcaggcggatgtacctaatcatgccggagtcttgctggcgggtaatttcttgctgcatcatctttatgggcagttaagccagaaagtgccgtatggtgggtactggaaagatagagcaataaaaattctgcggcacaaaaacctgttttgataaacagctatccgtcttcggtgctatgatttggttttctggaacgctggagggtggaatgcggaaaatcttattattattaacgctattaattttagttggctgcggggttactcccaaagagctgagaagcatgaaaccatatgcggaattcagttccactaagtcacctgattttctttccaaatgtatagcgtctggtttagaaactagaagttatgatggaatcggtgcgcaagtttattttagacccatgaacaatgggatgagcatatctacttttggaaatattgtattgatagatatattttctgagggttcaaaaacattagtaaaatattattctgcatacacccatacatggacatgggggaaagaagatagaattaatgcagcggtacaagatatcaaatcctgtatttaaaatttataactcaagccctcatttgagggtttttttatgaggtaattatggcttacatcgatataccgatgcgaacggtgcgtcttcatggtccactaatttctcgttttggtaaagaatttaaatacaaagcacgggatgccagacatgcaattagtgccatgcattgcctgttgcccggttttgaaaagtatatggcggaagcgcataaaaaagggctgacatttgccatttttgttggcggcagaaatatcggtcaggacgaaattgatatgacaaaaggcacggaaactattcatctcttgcctgttattatcgggagtaagcgtgccggattgttccaaactattttgggtgtagcgctggttgctattgctacaattgcaaccaatggttttgcaggtggattagcggcttctggatggtggggaaccgcagctatggcaggcgcatcaatggcgctcggtggtgttgtccagatgctttctccccaaatgtctggactgcgaatgcgtgaatcaccggacaataaaccctcttacgcctttggtggtccggtaaatacgaccgcacaagggaacccagttcctgttctgtacgggacgcgtgaaatcggcggggcgattatctcggcgggtgtctataccgaagaccagcaataaccgctattatttttcaaccgggtcgctcaggcggcccttttttatgggtgaactatgggacatcatcttattcaaggcagaaagggtggcggcgggggtggatatacccccgtagagtcaccagacagcattcaatccattgcaaaggctaaagtgttattggcattgggtgaaggtgaatgggggagtaatttagacgctacgcatatttatctgaatggcactccgctggctaatcccgatggagaaatgaatttcacgggggctaaatgggaatatcgggccggcactcaatctcaggaatacatcaagggattgcctgtggcggaaaacgaaatccggctaggggttgaattaaagagtggtacgccgtggatacgttccgtttccaatactaaattgtctgcggtacgtttgcgtttgggttggcctgtattacaacagcaacatgataacggggatattaccggttaccgggtggattacgcgattgatctggcgacggatggcggcgcttataaggaagtactgaaagccgtagtggatgataaaaccacaactttatatgaacgtagtcaccgcattgatttaccaacagcctcgacaggatggcagattcgggtcagaaaattaacgccggatactaaaaatagtcgcatcgcagacaagatgaatatcatggcttttaccgaggtcattgatgcgaaattacgttaccccaatactgcgctgctctatgtcgagttcgatgctcagcaatttcccaatattccccagatatcctgcaagccacagggcagaattatccgcgtaccggataactatgatcctgtttcccgcacttattcggggatttggtcgggtcaatttaaatgggcgcattctgacaaccccgcttgggtattttacgacattattgtgtcagagatgtttgggctgggaaaccgcatcaattcaacacaaattaatgaagcggagctgtaccgcatcgctcagtattgcgatcagcccgtccctgatggtaaaggcgggagcggtacggagcctcgcttcacctgtaatgtgtatatccagtctcgtgaggaagcgtggacggtattagccgatttagccgctatcttccgtggcacgacctactggggtgcgaatgagtttgtcacgctggcggatatgccggcggatgtctcttacatcttcaaccagtccaatgtgattgggggggatttttcatacagcgctgccagtgtgcgtacccgttatagcgtcgctatggtgagctggtcagatcctgataatcattatgctgatacccttgaagcgatctctgatgacgagctggtacgccgttatgatattaatcagacggaactcacggccattggctgtacccgccaaagtgaagcgcagcggcgcggacgttgggcattgctcaccaacgcgcgtgacagtgtggtgtcattcaaggtcgggctggagggacagatcccactgcccggtcacattattggcgtggcacacaagaatcgcgcaggccgggtgattggcgggcgtatcagcgctgtatcagaacgtaacatcacactggatcgcaaaccagaagccaaggcaggcgacaggctgctggtcaatcttccctcgggtgtgtcacaggggcgaaccatacaggcgattaatggcagtatcgtgactgtcacaacggcttacagtgaaataccgagagcggaagcaggctgggcaattgatgccaatgatttgtttattcagcaataccgtgtgaccagtatccgggacagcggagacggtacttttgaaatcagtgcggtttaccatgatcctgataaatatgagcgtatcgacaccggcacccgaatagacgcgcgtccgatttccgttattcctcccggcgttcagccgcccccgaaaaatgtcggtatcagcagttattcggtggtcaatcaggggatagcggtcacgacattgagggttacttggaatgcagccgagagtgcgattgcgtatgaagctgaatggcgacgggataatggcaactggatatctgcgccccgaacctctacacagggctttgaagtccccaatatttacgcgggacgctatcaggcgcgggtacgagccattaatgccgctgagatatccagtctttgggcgaacgcaccggaaactcacctgaaagggaaagagggcaaccctccggcaccgttgggcttcaaggccactccgattatcttcggtatccagctagactggggctttgctccccagacggacgacacgttaaaaactgaaatccagtacagcaagacgaatgacggcgaaggcttaatgttactggccgatatcccctatccccagcgaacgcacacgatgcagggattggcggcaggtgtcgccttctatttccgtgcgcggctggtggataaatccggtaatcaatccccgtggacggcattcattcgtggggagtcttcttcggatacgaactggatcattgatgcggcaagtaaggaatttctttccaacaaagccggccagcgtttgcagtctcaaatagactttaactccgaagccattatggagaacgccgctctcaccggtgctgttgttcagcgtcagttgaaggaaaacggcaatatcaaggccgaaatattggaggttaagaccacgcaagttacagacaggcaagcctttgccgaggatatgaagaaggtacaggccgaagtcggggagaatgcggcggcggtgcagacgaaggccacggccgtttttgatatcgacgggaatggttatgccattaactatgtcggagcgggagtgaagtacaacaaccagttctataaagccgggatggttatcggggctgaggtgaagaacggacaggtcactacctccattggatttaatgccgagaatttcggttggtttaatccggccagtggcaagatggagccgttcatgatggcgaaaaatggacagctatttgtgagggaggcgttttttgataaaaccaccatccaaaaactgttaattggtgccgaaatcaaatccgttaattatatcccgggtaaatcgggcttttattggaatatgcaaacgggacaaatggaaaatatcggctcagacagtcagggaaaaatgaagcagaccaatacgacgattagtattgctgacgaaaagggaaggctaagagggcaattcggaaaaatcacgggggtattttaatgtggggatttcagacatgggatgagaaggggaaaccgaataattcaggggttattccattcttgattgcaggaacaatcaccgtaccaaaggggcaaacctcattcagttatagctatgttttgcctgatggatacaagctggattacaccattatggataatggcggcgatattatggcgaatctggatgacaggcagaagtatgaaatccgggttcatggaaataccatcagtgcccacccgtcaagtctgggtattccttcggcttcgggaaaaaaagtcttggtattctacaggagggtataaatgtttggagcattattaaccgcgccggacgggacaccgtggctgctgccgcaaagcacgccgatgtgcctgaaagaaatagtgaccgattaccggcagataactaaagtcccggactcggttaatcgtatgatatttacccagagaaaccttgataacgatgagtataaatattatgtctttactgacgaaccccaaacaccgccgatagggaaatgggcggtttgcttttgggatgaaaatgggaaatgtattgtccatagtttgagtaaaacgctttccgtcatgggttcaatggaggatatttcaagcacgagctggtactggcaaacgcgggattataaggaaacagtaaaaggcagtgcggcggtattatcaacggtggcgggttatgggttttttttagtgcattctcatggctcagatggttccagtatgccattacccattcatgtccgttgggagccgtatgcccataaaaaaggcaataccacaacgataggttatgcctcgggcgatgaatttttattaaataaatccacgataaactcagaacgattcaccggaattcacagtcggatagtttatatagacaccgccatttacgactaagagaaaacaaacatgatctactcagacggcacaacgaatctcgtgtcaggctcggctattgtccggggaacgggcaccaaatggaaaagtaatattaacggcattgccgccggccaggttatcttaatccagtccggcaatggcaatttactgcatatgattcaggcggtgaactccgataccgaactggtgttggcagataacgccagagccaccctgaataacgcgaaataccagattcaaaccaccgttcccgataccgtttccgatggtgtccggcatatgtgtgccattaacgccgctatcatcttgttcctgcaaaatatggaccggtggatgagtgaaaacggcaaggttgaagtggaaatgccgaacggccagaaagtcacactggactccatccgggcattgcaggcagctatggatgggaagctggttaaggagcagaacggggcagacattccgaacaagccgaagtttgttaacaatctcggcttagcgagaacggtggagttggcgaaaaatgcgctgccgaaagcagggggatggattgatggcgatgtcgccgtacgtagtcgcgatgctgcgttgcgattatgggctgacggtgactccggtttatatatgacctatcaccaaaatagtaagcgttctgcgtggatgggttatggcagtgatggttcaaaaacatttaccattagcaacgaaaaagccggttcaacgatttctctggataaaaatcatgccgctatttatggtgcacaaagcttcattatcagttcaggatatgaatatagtggcataaatataacgaaaccatcagggacgttttttagattggagacagataccgatcagtctgtctccatcgttaattttgtagacagaaaccccgacaactcaaatcgcagtgtacaatccctacctaaaggaaacggcacgttattatctttaggagctaactgctggcgtgatgacaacgggtttatccgactgagctcccccatcatcataatccaccccgatggcaccttcgtcaccaacgacgaatccgaaggtgcgactgtgaccaaactcggccttggtcactacagaatatccggcatccttggctataacgctgacggggcatggggagttcatggcggtatcagtgttccccgtgacgtcaatggcaatgagttagtgtatgtcgaggataaagtgctgccggatggggctattgaaatcagggtgacgcaccgacagaacgcccatatgcccgctcggttgcagaaccgacgcatcaagtcacaggatgagcagacccattacacggatgatgaaccctgtgatttacctgccggcactcgattagacgtccgtgtccagatgccggaagattctatctggaaccagaaacaggtattggtgtctgatcctcagcaggagcatggcgccacgtcagccatcaataaatagccaataggggagattagcgggtagttgggtgaattggggaaattgtgggcaggttttggagggggtggtgtgggatttgaggctgtgacaggtgtaaaaagccctcaaggggagggcggactttaggaatataatttactatgatacagccctgaaaatcattattggtgtaataccgtatgcttcaggtggccttcccattttttctctaatcatgctaaaaacagctgaaaaactagtcttaaattcgcttactatcggctggtatggagtatcagaattatctgttaaagcatcaggatgagcatcaataacaccaacaacatgccatgttcccggtataattgatccatacttaagggctatatcaccagtgctgatagttagattgctagaattaactgacatccaaacggaatttccctcggtatcagtaaagtcaatttgtgtggatttgggtgctaatttcaggaattctgagccagtatcaaaatccttcttttcttgctttccctttggtccatatcctgtcatttgcatgatttttttcatagtaggaaacgattctactactatgttcacatcaaatatgctgatcccgccgctgatgagaacaagttcgcctaacgctttacccttcagctcttgttttaatagtcctttttcttgcaaagtacttaatagctcgaaaggcaagccgtaacttgaatcaaaaagttgttcttgagatttcgtcaacccatcagcatgaccagtagaagcttgaacgaaaggcacttttaccccagctttgatttctattttctctgagcttgaagacatctgcttgagattcgttagaacaccactttcatagatctgggatagaaatgaatttatacgtggaatatctaaatacaaataatcataaagtgaacttatgttttgtgagtcttgaaccacgttttatatcctcatcaaatttttcttttttttccatgaattccttctgtttactattcacgtagtcaaaagcattctgaacgtcactttcatgattttgttctagagatctcttgtcttttagggtgaacttcaacataattttaacctcgcatacatatagcttttccctaagaataggccttgattgaataaaaatcaatcaaatgccactgccatcccttacaataattaccataccatgttcatttggtaagggggtgctaatcaccctactgtaaatgtagtatttaacatttactatacgctgtacggcacaccctacattattcccactaatatgttgatcagaaattgcttaatttgtgagattatggacataattaattctcttagagatcaactaaaagttattatttaaacttgaaacagtatcgttagttatattattgacaggtgattttcatgattgatatgaacccgcagaaagttgcgggttaaattgtcatctcagaattaagctgctctcactatataattgaatgctacgttgcgggggcgactaacgccaatgtgggtactatctgtgttccattcccaacttgcccctgttactgcctttgcgcgcacttgtacgttactactggggggatcccattttagcgcagaacgctcatcgagtgagaaattaactacagtgtcagtcttatcattaacatcttgcaccaaataagaaccttcctgccaagataaaacattgcgatcagaatccacgccacgctcatcatcccaaccacgaataaattcacctcttaaatcaggtaatctgccggatggataggcaagagccagttttgggtattgttctgtatcaaatacttcaccattgcatttaagccagccgtctggtgggatttctgatggccaaggaacaggaacaccaataggtatcactgtataaccaaagtcttcataagattgctgcgctaatgtagtatcttttaattctgatatatcaggctttttatcttgcatacttaatccctcatttaatcaacaataacattgctaaaaaacatgaaggcgggttacttctccgccggtgaacataaataaaaaggttcatcaatactggagagaacttctgattaggatggcacggaatggttggtgggacattaacaaaatctatttgcctatggctgactgataaaacttagcgtttaaagggaacaatcctcccctttaacctaaccccttgatttatccgaggtcctcactttggctcagttccaatcggacaaatttttggctgatcgcgccaattgggatttgaaagcccatttgagtgggaatgcctactttggcgataacccattgatatttaatcaagctgcatatttgcagtttgcttataatttgagcgtcagtgatactgactcacaaactttgtgcgggtcatttagcgacgcgcaaaaagaaaaggtattgcggatcatcttaagggcaagtttctgacctatagcgacagtagcttctcttctcaccgttctacgatggcttttgcctgccagtactgaaaccattcaaacaaatgcgcgtgctaaagtgattcactgagacaacacaaaattaagaattaactccttatttatcaatgtgatgataacttttagtgcagtgaaaagtaaaattgagacaacataaaatagaccgtgttgcctcaatttttaaatattaatcattataaaacaattagttaagttgattgaggcaacagagacaactgagacaacactgtttgcttaacttatatattaacgagaaataaaattatcgttattcatgagaatgaatttaaggcctaccaggttttgagagggcgataccttttggagttcttggtgcagaagtgagtgaatgactgacgacgaatttcgtcggaagtgaatctataagagcgaaaaagcatctttaatcttaacatactgatttttatcatggtcaaaatcttgaccatctttaagtgacatagatgactcagatttgagccatgactaatcatctgattttattcatgaacaaaaaaccggatcatctcaaggtgggatatcacatcttggtttatatatgcaggtgagggtatggtgatttccaccataccttttgctttcatatttacagggttacttaatgtaacttagtgactaacgacaaatctgacggcagggcaaagccctaattcgggctttggtgataacccattgatatttaatcaaacgccagatttggcgtttgcttgtattttgagcatcgaagatatcggtatgcaaaatccaatatccgataatcggactttgcgggttactattggttactcacaaatgacggtgagcgtaaatgatagttactcgcaaaatttgcacaactcaataagaggtgtgcccaaaagagtgatttagaaacaagaggttaagtccttttgtccagaccgttatgtccaagtaatacgttgaaacacaatgcatttattccttttgtccagcacataaattaaccattgggattctcccaagagttgaaataaagacgaatttacggaagagatgtctcgggtggtcaaagtgaccacctcggaaaaatcaaagggttagcctgctagggtggaaatcatcacggttgccgcaaggtgtgatatccgatctagggtattgagatttcctcaacaccttttgctcgtgtgagattttcacaactgaaaagttttttgcagttgacgcttttgcacacacaggagggcttgagtttaagccgtcatagtaaaagccttataaaacaacatggtcaaaatcgtgaccatctttaaagtgggtatcaccatttcgatgataccttttgctgaatgtaactgactccatatgtattacgttcgcagtgatttacttgtatgtaattcattgattttcatcatgaagcaaaaaccagatcatctataggcagtagaaaatggtactaagacagaagaagaacgcaccattgatagtcgccacagtcacagggaagataaccgttgcccccaagcgtataaagtgccagacaggtacagagtgataagcgcagtgattatctgttacgtgtcgttggctttgatgagatggcgctatcggtgatgctgttacagaaaggttaggtgatcactgttatggggagatcttcttactggcagggctatcagttagctgtctcctcaatcactcaatagcttccgacgcaatacgtcgcgacctctatagctcggaacgttaaacgtactgacctactcactgaatttgcagagcgcaattttacgctttgccatgaaaacaatgagtaacagggtggtaagccccagtccttctactcactttcgacgaaattcgtcggtagtcattagctcagtacatttagcgtgttgacctcacttcattgattgtggggatatcagataacgacaaaaaaatagattaatacagtgaaaggtaacaaaataatgtgggggcataaaaaggggcactaaagcaattagttaaaaataaatgtaatttattcaataagttacttttatttaccagtcccgccctggcaccatataaaaacttgctttagtatcagcgggttaacgttaagaaagagccacctttacggtggcttttttgctttctgtgattacataaaagtggcgatttggcagcagattggcagcgctttggcgacactgtataaatacacactatctattcgatacctgttttccttcagacaccccgcagaaaaaaatatttttcacataaaaaaaagcacatcagattgaatcacaatgtgcttttgttgattatttattcagtctcgccaatcaaaaagacatcacagtttgctgaccactggcaggatggggcggagcggcttcaatcagggtcggtttagtcacgtaccggacaaaggtttcatggctgacgaacgtcgcgccacaattgatattctggcactggttgtaacgttctttggtttggggggtatgttcaaaactgctgcgggtgtgggcaacatgatagcacagggggcatttcatcataatatgagtgccttattgaaaaggactgccagctctgttaggcaatggcgcgattatagcaaatcaggcgctcatgtcagcatcagaaattttcacttccagctctaaggccgagatcaggccgctgtcattcaaggtatgggtgacggtgaccagcgtccagtctgccgcgtcaatctggggcttgaagccgctgacctgcactttcatttcgggaaacagttccggccgtccctttgccaattgaatagaaaacgaagcgaccccgcgctggattttctcccattcggccttagccgcccgctcggcgttggttttgttggcgtaggtatgtttcagtaccaggacattcccctcactgccaatcagataatccccttttttttcgtcttttttctgcggattggccttgctgggtttgcgccgcctgcgcttgacggtgatgttttcttttttcttcggttcacgggtgttcagccaactggccgaaaccccggtataagccccacgatcagccagtgaaaagcgatagccgtcacccgactggcgggtcaggatgaccgcaggcaggggttgaccgctggccactttgttttgcccttgccggataaacaacagacagccgttcttgaccgtggcaatggcgccttcctgttttgccagccgggtcaggaaactgccatcagattcgttggtctggtcaatatggctgaggttaatctcagccagcgttttgtctatccgtactggtcgggcaaactgattaaccggggacgcgccaaggcagatcgcattgacattgatgtcagccatgacgttttgggcggcggcctgcggtgtgccgacggccagtggcggcagattgtcacgattgaagatgcggtgaaaggcggctgtaccctgtttgaccttgaccagttacggctggaatacagccccgacgagtaccagaacctgctgatgtgtgagtttatggacgatatcgaatccattttctcactgcccctgatgcagggctgcatggtcgatagctgggaaatctggaatgacgtccagcccctgatgctgcgcccgtatggttacaaccccgtctggatcggttatgacccggccaagggcggcgaaaagggggacagcgccggttgtgtggtgatcgccccgcccctggtgccgggcggcaagttccggattctggagcgtcaccagtggcgcgggatggactttcgcgcccagtcggacgctatccagcggctgaccgaacagtataacgtggaatatatcggcattgactcaaccggcgtcgggcatggggtttaccagaacgtcaaagagtttttcccggcggcacgggagtttgtctataacccgtcggtcaagaacgccctggtgctgaaagcgtgggacatcatcaaccaccgccggctggagtttgacgccggacatacggacatcgcccagagttttatggctatccgccggtcgaccaccgccagcggcaaccgcccgacctatgaagccagccgcagtgaagaagcaagccatgctgatttagcctgggccaccatgcacgccctgtttaacgaaccgatcaccggtgacaccccccaacacagaaacatcgtcgaggtctactaatgagccgtaaaagtaaaaaacgccagccggtgaaaaccccagcccctacccagtcaatggaagccttcacctttggcgacccgatcccggtactggacaagcgtgaggtgtttgattatctggaatgtgccctgattgataactggtacgagccgccgatcagttttaacggactggcgcggtcgttccgggcagccccgcaccacagcagcgcggtgtatgtgaaacgcaatattctgaccagcacctttgtttcccaccggttactgagccggcaggcgttcgattcgtgggcgctggattttatgctgttcggcaatgcttatctggagttacgcaaaaaccgccttggccaacctttaagcctgcatcattgcccggccaaattcacccggcgcggggaagatctggacacctactggtttgtgcgttatggctatcagagccagccgtatgcgttcgagacggggcaggtgtttcacctgattgaacccgacattaatcaggagttgtacggtttgcccgaatatctggcggcgttgccctcagccctgctgaatgaatcggcgacactgttccggcgcaagtattacctgaacggcagccatgcggggtatatcctgtatatcagtgatgcctcgcaaaatatttccgatgtgaacaatatccgggacgcgctgaagaacagcaaaggccccggcaacttccgcaacctgtttctgtatgcgcccggcggtaaaaaagacggtatccagaccattccgctttctgaggcggcggccaaggatgagtttttaaatatcaagaatgtcagccgtgacgatatgctggccgcgcaccgcgttccgccacagatgatggggattatcccgcagaataccggtggctttggcgatgtggagaaagcggccaaggtctttgtgcgcaatgagctgatgccgctgcaaagcaagatgaagcaactcaatgactggctaggggaagaggtgatccggtttgagcgctattcactggaggatgaagagtaactgacacgacggattgagcgccgcctgcgggcggtcttttttttgcctgaataaaatatagtttcatgggtaatgattgtatgatgaaatttgaggtcggcacggccatcaaacaccaccgcgcgcagtcatgaccccgccacgcctgcccactaaatgcagtgctttttatgcacctgcaagggattgtttaaagcgcgccagtgctggcgcttagtgggatgtgagatctttgtttgatcttgcggattggtgcaggaagtgaacaatttaggtcccaaaaatcattattcttttctggcctgtattggatttatttataattatccatgacatttattatgaggaatttttatgactcatcaacgcacatacatctcccatattaacgattttcttgagcaggaaagacgtcagggacgacattggcgaccacaccgagccataaatgagttttattacgctggccctgcaattatcacagggcatccaggcaaccactatccattgttacatttagttttttcttttaatggttttacagaatctctaatctatttcactggccctagccctcgtcctatctctagctttgtccctagcattgtccctaactttgatcttcactttggctttgacattgatgttaaccatagcatgtgtgtggtgttatatcgcaactctttttggtttgaatcccgtgtagaccaacttcccagagatatgcaaaacgctactcgtgctcttatggcacattggtttcgatacggttaacacttatagagttaaccgttatcaatatcccgcctcccaaaggcgggattgaatacagcatcgtgacatctcacacaatcacaattttaactcatgccagcctaaggtattccagcacgtagcttcaccagagaagcagcattcagccacaggaagattgtcaccacactttttctggcgtaagtcagcctcatctttgcagatcagcgaggcgagatattcaaccacctcatagggattgcgcctcggccgtttcagtacacaattacgcttcaacatgtccagctcttgattatcgaggagcaattctattttggtgacgccagcttcctgctggcgttgacgctgggcggctttacgttctgcgggggatttagccattgggtttgttctccctgatcaccaacgcggatgcggcaagcggcacaaaaacagctcttcaaaagcctgcggtgaccacatgttacggatccgttcctcatctaagcgattttcaacatcatcaaacaatgtgactgtatcgaaaaaagccgattcacctttgacgcaattccgggtaaagaattctttgtaggctgcctcgccgttgtcccctgagtctctggaagaataaaacgttcttcgccactttgtatgcattgatatcatcaaagccagacgtatcaacttaataggatcatcggaataagcccattcagagacatacacatcaccgcatataccagcaacagaactatccccatgtaaaaaataaatttcagcgccattactgagcgtcagtaaccggatatcttcggcattttcggttaagtgcgtttgctgttcaggaaaatactgagcaacgttataaacaaaattccgtagccaatctttatcagacataaaaatcttattccggcctgttcgacaggcatcgcttaatgcttccagtacgaaataatgatcagcacccacctgcctgcatttatgcaaaaagcgattacggtgatgttgattggctttccagcgcttctgccagacgaataaatctaaaacaaatttacggttaatgttgtaaataatttcggtatttaactgtaaagtgatcataaggctacccttcctgcaaaattttccgcaatttcctcaattcgctcactgagttgctgcaatgtttttatatcattgctatcaacccccattctgatcatgcagcggactaattcatgcaaatttgtgtaatatctgaatggcgttaaagactcgcagcctgcatttttacccgtccgcgatatcgtctttttattcagcgtgtatgctcggctaaagtcgttgctgatgcactggcgttacctttgccagaacccaagccagccagaaaggaggctcccaaatcaggggctcccctgataccacggtcgggcagtcggactatctgactaacaaggggctgcaatgcccccatcagcggctactgaaagacggttctttgttactggtcatgcaagcgttggacggaaccgtagcaggcgcccagacgatcaagccgaacggtgaaaagcgccttgtctcaggctcacagaaaaagggcagttttatctccttatccgaaattaccggaatgcctgacacgttcatcattacagaaggctacgcgacggccttaaccgtcagccagttgcatgatggcgtgatactggctgcaattgatgaagggaatttaccgactgtagccgaacaggtcagggaacggtggccaactgcgaaaatcattcttgccgctgacaacgatatgaagtccggtcataagaatgtggggaaaatttcagcagaaaaagcggctaaatctgtcaggggctgggtcacattgccgcccacggaagagaaagcggactgggacgattaccgccagcgtcacgacatcgaagcggcaaagcaggcattcagtaatgggttgtatcaggtggggaaaaagaaccaatgtcagtggtgattaatttagcggaacaccgtgagaaagaacgtgatcccctgataccgtttattgatgtgcgcaacaccggagttttttacgcgaccccgaaattagacaaagaaaccggggaaatcatcaaacctgaacagtggttatgttcaccgattgacgtgatcggcacgggcattgatgaaaatgatgagcaatacctgatagtccgctggaaaacgaagggtaataaagacccggtcattaaaggggtagcgtcggccgacattggagaacgcgaaggctggcgaatactcaaggcgggcggtgtgcaggtgaccacaaaaagtaatctcagggcgatcctggctgactggctgatacgaagccacacaaaggaaatctggagtatgacggcaaaatcaggctggcataaaggggcgtatatcatgccggacggttcagtgattggtgtacctcagcagcctgttttgtttaacgggggaagcgctgccgcccatgcttacacggtttcaggcacaacggcaagctggcgtgaacaggtggcgcggctggcaaataataacccgttcatgatgctgggcattgcgacggcgttagcggccccgatgatagggattgtgggggcggacgggtttggtgtccatctgtatgcgcaatcgaccgccgggaaaaccacgacagcagatattgccaccagcctatacggtaagccggatgagcaacggctgacgtggtatggcactgcgctgggtattgctaacgaagccttggcacacaatgacgggttgttatcactggatgaagtcggacagggcgcaaaccctaaacatgtccacacctcagcttataccctgtttaacggtaaggggaaaatacagggggcaaaagaaggcggtaaccgtcctttggcaagctggcgaaccgtggtgatcagtaccggtgagaaagatatccccacgttcttgatggaagccgggattaaaattaatgccgggcaattagtcagattgctgaatatcccgatggaaagggcgaaaaccttgcacggttcagaaaatggtaaggcgcatgcggatgctttaaagcgcggctgtcgtgaacattatggtgcggcagggcgggaatggatcggttatctatcgtcacaccatgaggaagccagacaggcttatattgaggcgcaatcacggtggggcaagttgataccggaaagttatggtgagcaggtacaaagggtcagcgaccgctttgccgtactggaggcggctttaatgttggggcgggtcattacgggctggaaagcgcaggattgccgcgatgtgttgcaatatatctttaatgtctgggtggcggagtttgggacaggcaataaagaatttgaacagattgtcgagcaggccgtttccttttttaacgcccatggcatgagccgctatgcccctctgccctatgatgagcgggacttaccgattcgggatctagccggataccgggaaaagaaaggccttcatgataatgatccgatgattttctataccttacccgccactttcaagcaggagatcgcccggggttttaacgtgggtatgttcgcagacacgttagtgaaaagcgacatactcaaaaagccggccagtggaaggagctatcagggcaagacaccccgccttaagcatctggggggcattcagcaacgggcttacatcatggtgttagtgcctgaatcagacgaagaagcctgatcttctcatgtgagggttaaaacctgttgtctcagttgtctcggttgtctcatttttattaactgtatgaattgtaattattttagtttttaaattgagacaacatgagacaacaaacaagggttttgagacaacatcaaacgggtaaaagttttctttttggcaggccattggaggcattatgagaaaattacgtaaattataccgtcagaaaatcaatggctttacgggcatgcggttggaacttcacaccttgtccgaagagcgattccatgatcatgagctgaccgacaaaattattcttaatctggtgggggggtgtgccaggggttacgcatgaaaatatttagtggataattctttcatttttagagggacgctaatgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttagccgactaaaatttcatgcgtaacccctggggggtgtgcggtatgaaactcgaatcagccctgaaacacttttacccgaaaacaccgacgttcagtgatgcgtcaaccagtaccgcaccggacagaatgaaaggcatggataccgcagcggctttggggatggcgggatcacaagccaagttcgggatggcggcatttttcgccaagaatgaggtcagtgaagaagacaagttcagtaccgtagaagaactgacccgatatgcaaggcgaaccatccctaagctgatatcaaaggcagcggggaataaactggggccatgtctggttatcttatcgaagatggcgtttgaagattatgcccgttcagccgcgtcgacttgtcagtgttcggaatgtcgcgggaaaggacttatctacggcatgaaagaagtggaaagacaccccggcattattcgtgcggacggtgaagtgattattgcaccgtggattgaaaaagagcaggtgggtgaactttgccagaagtgccacgggaaaggcgtactgtcaagtcgttgtcgctgcaaggggcggggtgtcgtagtcgatgaggaaaagaccgcattacagggcgtaccggttgataaaatctgccctcgatgctcagggcggggttacagcagagtgccatcatcagtggcttatgcggcaatcaaggcgcttattcctgcattgactcaatcatcatggtctcgcaactggaagcccttttatgaaaagctggtaggtaagtgttacgccgaagaaagcagtgcggaagctatgtttagcaaggtgacaaaataaaccgttttatgtcatcaacagtatttgcattttgcataaagatggcttaatatcttcaaatagtgggaacttgtaactatactcactacgaattctaagcctcgcccagtgcgctgagggatccccacaaattagcgctaataaatcaaaaccatgttttggtagattttggcgagatatttgagtgtgttattaagaacgatttcaaataatattagcggggaatgccgtaatacattctccgctaatgtaagatgagagataactcgccttgatttaatactatttgcctgataattaagatgtattcctttattttcggcataaaaaccaatcagccaaagtacaactgaactcagtgtagcaagtagactcaatactgataaacgaccagtaccgtggctataacttgctctaagaccaaatccaaaacgttcactcttttcatccctaaaattttgctctatttgcattcttcggctgtaaattttcataacctgacgaggtttaaaatcatccatactagtaaaaataagccaaggttccattgctgccgaacgtccatctttgacctgagattttcgtaccattcgatatcgtgattttttgaattttctccctttattcggtcttttatgaagataaaaataaccatcgcaacgtgcatattctgcttttgataatgtgccaaaccctaaaaactgtggggttgtagttgcttttaaagcttgccgtttaaaccaaagctcaccctatttttcaagtcttagttgagtatttcctcgaatgcgtccgacgaaatcccaaccgagcgtttttatctgtttgaaccctgcattttgaaaacctgcatccgtaacaataattactctagctttagggttaacagcactcgctagcatgtcaagaaatgcattttggatggttacattttgttgttcacatgagggaactatttgacttaacaaaggaattgagcgtccatcacaaattcaactcgcacggagtacatgatgttcttgtgagggatatccactccaatcaacagctatgacacacaatgagagtgactcagtcagcatagcaataatattacgaaagatatcaggaatatccctatgaagagcttcattaccgagtagccgatcaatacgtttaattttatgtttgacgtgagcgtttcctggtaaaaagcgcccaatgctggttaacgtaagagaagcaccattaatcaaagcgatagtggcatcgattaatgcattctgacgatatttatgaaatggtgataaagcatctttaaagaagttatgacatatttcacgtacaggcatagcagtgaccttattgacttggtggaacaatcagtagatcacacaacgctatgcctgtctattttctggggattcctcagccctaacgggggttttttattgccagaaaaacagataagagttgctattccctttggttggaattgcatgtgtagtatcctagtgttattgatatgtagccatttggagtgtggtatgttaattacgctagttgatataaataaggacaattatgaggctgtctgcgatctatctgtaactgatgaacagctagacgctgtcgtcatgatattttcagccaaagaacaaggcaacggatttgcactgcggcaagaaaagacgcgctattttttgcatagcgagtggctataccacgccagcgcttaagatgaaggaaagcattttcaaccaaatggcgaaaccgatagagttcacgatcatattctctggcggccttccgatttttccggctagggatatggacttgcatgccttgttgttctgctttttctactattgcgttgctatcatagcccctgtccgccaatagatgctctgcatcgagccctttaattaaggtctccgcttgtgaacaatctgctgtggtaccgcttgtaataacaattctgaccggcataccatgcgcatccacggccaaatgtatcttggtattgagcccccttttgtgagccccatatcctgattaccccctttagcgcctgccgcatcgggatgaaccttaatatggctggcatcaatcatcaaccactcgaaatcggggtcattaaccaattgttcgagcagtttttcccatatccctttatctctccagcgacaaaaacggcggtgggtatttttccagtcaccataatcagtatgtaggtctcgccaaggcgcacccgtccgtaaaatccaaaacaccccattgataaaacgccgattatcttcagctacacgcccccaagcgccttgacgtcctggcaaatgaggttcaagcaggctccagacgcgatctgaaatatcgtggcggcggtgtgcaggtgtactcatggttaatcaactcttatgatggaatggtggggcattattattgcacgaaatttctcatgacgacaccatctagaatatattgcggaaaatgtgttttctcttgttcaatccaaattttttccatcatatgaaactcgcgcgatttattctgatagtacgcctgttggtttctttatgtgggtgccttctgataccggacaaaaaacaactatttggcgctttatggtggataagagccatcaaaataaaggtattggacgcaaagcgttatcactggctattgaggaaatcagacgcacagagcaattggaagaaatagaaatcagttatgtcccaagtaatcttgttgcgaaaaatttttatgccagtttcggctttattgaagttggtatagatgaagaagttaaagaaatgctggcggttataagggtatagtcacaagctctactcaccggaaatatcgaataaccgatcatggtcggacagcgccttctatcattgttaaatcaatatcttagattggtttttgggtgatatgagcagcacctcgatcggggttagagaacaccccacatgctagataaatcaacgtgttaatgtgattttcagcgaaaaagagatcacccccatgaaagatgaattcgaatggtgtgatgagttcgatggattttaattcccccgaattcgagggaatctagcagtctactttttattttcgccttttttcaatttaagcccaaagagaacaagcccaatagccaataagctttcgacagtacccagtaaaagatcatcatattgaatcaatctaatacccgccgtaaaaagtaatatcatgccggcaagaatgaatttaaatgacttttgtttgagtgggtttttatcgttcggttgcataaaaatccttttatattaaatgttaaaatctagcatgagtatcacatgctcggtcattctgaacaactcaacctatcggtctgaccgactagttcaaattcaaggctgcgctccggcgtggcctttttcatatctggaactttggcgtagagggttcgcgcggatgcctgaagagcattaggactcggttcgattccgagaggttccaccaaataatgatgaacacgctactttgataattgataaaataattttattaatcttttaatggtgtgatcattgaccaagaagcgcttgtttattaatcgtattatctcctgacgtacacaacaataggagaaaatgcatgaaatattacgttcatactaaaactgataagcagggtgatcatgaagtgcacagcgaagggtgtaatcatacgccactagatgaaaaccgagtacacctcggtgactttactagctgtcagtctgccgtgaaagaggcaaaacggcggggctacagtgctgatggttgttactggtgttcatcggaatgtcacacatcctgatatcagccatatgaacataattaaaggtcacttaggtggccttttttattacctacgcaatgaggaaattatctctgggcgctcgatattgattattacctaattatgccaccgcaatcactttcagtacctctgtatctcctattgcgatcggcatcctattaactcaatcacaggggcgaccatagctcaccccacggacgcccattgttctgatggggtggaatatgaagatgaaagagaatcctgatttctggatgcatctgggtgactggctcatatcggtaagagagcaaggcatctgggcaacccttgcggggacgatggcattttttcgcggtcgctataacggtggcggctgggtaaaggtttcaatcgacgcctttatgtgtgccatgttcgcctggttcatacgtgatgttttaaatttcatgggtctgaatccagacttggcttacatcggcagtgtggtgattggctacttgggtacagactttatcggtcaattgctgcgtaaggcggcagagaaaagagcgggaggcagcaatgacacatcagatcagtaaatctgcatgtggtgtggatacgttgcttcggattcgccgttggtgggcgctacgtagactgagaaaccattggcgtgatgatatgcgttttttgagatttgcccgtcaatacaaagggatgagcgaccatttcaatttttacaaacgctatcgatttctcaggttactgacagagtatgaacaacaacggggaacaattttatgaccagaggcattcgcaacaacaatcccggcaatattgaccacaactcagcgaataagtggcagggtcaattgccccacgacccgagtatagaaaagcggttctgtcggtttgaatcaccagagtatggcattcgggcgctgatgaagttgctgtgcaattaccataaaaaaggctatcagacagttgcgaagatgatagaccgctgggcacccactaacgaaaacaacacctccgcttatatcaagggtgtggccaaggcgttaggtgtcgatcctcatcaggtgattagtgtcgataaagtgacgttgattgtgttggccaagtcgatcattcagcacgagaacggcaagcaaccgtattccgatgacattttcacacgggcatttgaattgctatgaagtggcaattaaaaatcggtgcagtgattgtggctctcgcgctgattggggcagcagtccattccatctactcagtgtatgcagaaaacggacggttaactcaggatattgagacgctgaataagtctctctcagaacaggtcgccatcaacgccacccggcaagagcacatccggcatctcgcagaactggatgccaagcatatggagaaactcgccaatgctgaatctaagatcactcagcttagtgataatttgcgcactaacgttaagcgcgtgtacgtcaaagcccaatgtcccgtgtctgaaaccgctgccggctccggcatggatggttcaagacccgcccgactggagaaagacgctgaacaagattatgtacgtctcctcggagaacttgaaaccctcgaaagccagttcctcggactgagggattacgtgaatactgaatgtgggagaaaagagtgacagacaaacttaaaccttgtccgttttgtggaagtgaagcacaccattacccagatggtgacatggaagggtattcaatccactgctcaaactattcgtgcgtcataaatacatttggttatctggcagctaaagaggccgaggatgcttggaataaaagggcaaataacacattgccaccgcagagcaaatgattctggggttgcaggagtatgttaggacgcagtgtcaaagcccctaacaacttaggggctgtgggtttggtggttgaacattaggaatagagttaattatgtttagtggcttttatttgtaattcttctatcacgaatttttttacaaattcgataaggccttcatcgttcccacggttgtaatcagatatagtatcatatgatgttgtgacatttattttgttattattattatctagatctactgcttctatatttacttcgccatcagtgttttcataaatatgtatagcatattctatgccttgaattaaaattggactatattttttattgagcattagtaattatcctttttgaaatggttttcacaaaactaatttatataagaagctatttggtttgaactaggtaatgttaacactgagtgaaaaaatgaggtgttatctttttggtctaagtcagaactaaaaatataggcaatattttactcttaactatatcaatattccttacccattcccttgagtggttaaaggaataccccatgccatcagttaacgctggtggcttttttgtatctgagttccgcgcactcaccgcgcatatcaataaaacgcagccttacagaaagtcgaacctgagaaatccgttaatgggtatttctgcgggcggctttctacgtgagcaggttcgattttctataaggaaatacccgatgagtaacatcattccatttgagtatgacggtcaccctattcgctttaatgaagaggggtggatcaatgccactgatatagcaatgaagtttgataaggagccgacagcatggcttcgtcaaattgatgttctggaatatatatccgctcttagttttcgtgtatttggtatttctggcactgtgccagagattaacgaaatcaagaggttagcaataagttcaggtgcagctagagccaagatactgagatttgctaaaaagagcggatttgtgaaagtgaaaagtggtccaactggaggcacatggttacatccaaaactcgccatccgttttgctcgctggttgtctgttgacttcgaaatttggtgtgatgaacaaatagatgtattgatccgtggtatccaacccacattcactgaccaacgcatcaatgccatttttcttcttgataagcccgccacatgggaaaagcgttttcagcagccctcttatcaggcactcagccgtatgtcaggtttgccttataagggtcatgttggcggcaccccgtcactgtttgggatgatcacatccaagtgggtgtatcaggttgtgttgcctgactcggtatatgcggaggcaaaagaagcagccaaaagtagcggggacaagatccatcaataccttaaaccggaagcccggaaactggtacaggagcaactgaaagcggtcacgatactggctaacggctgcgtggattacaaagactttgaggctcgttgcgttcagtcatttggaaaatcaggtgagcaaggtttgctgattttaccaatagaaagggaattcagttactcagcggtcagacattagttcctttgcgccgggttatcgccgtctgcctgtattagccatgacatgttccctttgcatcgagcgtacaggtcggaatcaaaaataatcaatgccctagacagtcattatcagcaacatccgctgtaggcagaagaagcggtgtgacagccggagagacggcctgcattgccatcatgattcacagagtcgtgatagctatgtagtcaaagaacccaagtctgattatcggatattggattaaccacatatatagaggtcaccatgacagaactgaactatgaagcgattgggcgttgtaaggtgttaagggaaaagatagaggctttacgcacgcgaagacaccaacacgtttataagctgagagatgaaacttcaaggctgacatttagtgatggccatttgatacctgaaattgctgagtttgatatgggtctcatgcaaagtcagctgaaagatattgcccttgtggacagtgacctgatgcacgcagtacgcgagtttaatatctggtgtcaggatgcaggagaaccatcaataaaattaaatccttcaactaagaaagatttggagaaattaaaaccattgtcatttgatgggtttcccggctctgcgttattagggcagtgatgtggaaatgctacataaagacgcagggcaggttatcaataaagccatcggttaacacgggtggcttttctttttggagaacagaacatgacacagagtatctacttatcactaaaaggcaagaaacagggattaatttcagcgggatgttcaacgcccgaatccatcggaaatcgctatcagacaggccgggaagacgaaatacaggtactgagtgtcagccattcagtgagccgcgaccagaatgcgcatcatcacccggtcagctttaccaaacccattgataaatcctcgccgctgttagcaatggcaattgacggaaacgaattgctggaagcacgttttatgcactaccggacaagtccaatggggcaactggaattcttttatgaaatcaaactgaccggcgcgacgattgtcgatcttgcctataattatccccattccatcaatgataacggcgcaataccccatgaagtggtcatgctcgattataaatctatctcatgtcagcatattgcggcaggaacttcgggctacagcattacacaattatccgggcgcgaagaaggcaggccgctattgtccgggttctcgaatgttataccaatgaagaaaccgctggtcgaagaaacgccggcaaaacctgctaaacatcatgctcgctatcgttgtgtggatgacgatggcaatcttttaaccgcacacaagtatcgggtttgcctgccggatggtcaaataaaagaagggaagactgacaaacaaggttacagccaatggcatctcactgatgacaaaaataaacttgaatttcaccttttaaaggattaatgccatgccaacttataccgtttatacccaagttaaatcgaatgttccagccgaaaaactgctttacgatttaattatttctcgtcaggatgaaggaggaaatcatcatatattactggatgttgaaaaagcgcaattacaaagtaattatgaaacgcaaaaacatgtcactcaggaaaccgatgacgatctttccgtgatgtatattatgcaaatcatgctttaccgcaagcatggttcgaatacgattcaggcattgcaagcgccttttaaaaaaatgtatacgctgggcgaattcgtggctggcaaagcctgttcggataataagcgagaaaatgcctgctattttgaaagtacggctgaaacaaaacctgtcagcgatggcgataatacgatagaattaaaaattactattcctgaaagaccgtttattgcgaaagaatatccaattggtcatcctgacgacccatttgaaaaaaataaaattgaatcggaaattcaaaataggatatctaaaaaaaactttccagatcaaaatggggcaagtttatgtggtccagcggcacttttttattgtttgcaaatggatagacctgatatttatgagcaagctgctcgtgaattatggcaatatggcagaactaaaattggtcaattagaaattaaaccgggtgatggttgtcgtcatcctaaaggaactttttatgacaagtacggcgcaagaatctcaggattagattggttgacattagccagtttaagagactcagaaaatatgatttttagttatgatgaggttgatgataaggctgctggtgtgactatgtggggaaaattgactgaatggtttgaaaaagctggttatgaaaaagtatttagtaatattggattgacacatagtaataaagaagatatcgaaactctgaataattatatagaacaaggtttccatgtggtctctttaatttctgctggtatgttgcaaaatatggaggaaacatcaggaaaaaatcattggattgtttgggtggataaagtagaagaaagtgaaaatggtactaacgttaaagcattttcatgggggagagtaaaaacttgggtaaaagaggatgctacgtatgagtattttatcaaacacacatttggaggattggttttcaagccacttaaataaaatgaaaaaaataatatttttattttttattatattaacctcatcatgtagcacaatttcggtatctgttcaacctaaaggaaattatctacctgacgctatggtaggtaaaaattatcacacttctatttctatagtaggagggccagtaattgtgagtgatgaaaaaaaaccgactaaatttgtcatcatagaacccaacgattctgggatagaatggaagcctagtaaaaagagtttgatatattctggaaaagaagaaatttgggatgattataatcatttagtaataagtggaaaaccatcaaaatcaggggaaatatatataacagtaattggtcgtgtgtatggaactatgttaaatggctccggagagtttcaaaaaaaatatactataaaagtaaatgaataataaatataacggaatggcgatttaattcgccatttaaaatgaaatcttttgtaaatgtttcgtcttcatgttttcccttgtttagcctctgaattccagaggcttttttattattttttatggtgttaaatagtgttttaaagaaaatagctattccgaaaaacaccatgaaaaaactgctcgaattacgccagcaaaaagcaacctttaccgaccaaatgcgttcactgctcaccaaagccgaagatgaaaagcgctcactcaacaccgatgaagctaaacaatttgacgaactgcgcaaccagtctgatgccctgaatgcagaaattgcccgttatgaggctctgtctgatgaagaacgcaatcaggccaagaatcagcctgccagcaagaacctgacggcttggtgacgacggtgctgatgtttaagcatgggtcttgcctctttttggtcgttggtcatttgtggttttagttgcgatagcgtgttttatttttgccaaattgatgagcacgggtttaaattctgttgctgttcctttcagtttcctgttggtattattgactatcgtatgctctgcacgggtaatcaatatcagattatcaatatcacagttcaaccggttgcagtctttaaacgtaatgacactgttttcagggcgtttaccgtgatgtttttcccaaatcagatagtgcttgggtttccatatgccaggatcggaaagcttgacatccacatagccatgaccattgatgcgctcagtgccaacgggttgtttattccaggtcagatgtccttttttaaacgagccaagagaggctttcaatactccctgggttcctgcatgaacgggtttatctcccttttgccatttagctgactgtctggtgcgcaaacctaaacttttacgcaggtcgctaatattctccctgcttcggttcgtattaaagcggccattaaacgcgtccgtgagttcatggcgcgtcaatttataatgttctttcatccattgtttcatttcatctgaatatgaaaatcgtgctttcttcatttttgcccctctgacgccaattttatcctgcttgccaccgctatttttatccgtgccagattaatggcggtcggtttatgttctacggatacggcgtgatagtaattgtttataacgccatgctccttgtgagtgagcatcagtaagttatcaatctggcaattttgggtgttaccatctttaaaggtcaggatagtgcccttgggtcgtttgccatgatgtttttcccaaatgacgtggtgcttcggccgccaaatattgggttcggccactttgagttcggtataaccgtaaacattgacccgttctgctcccacatcgcgtttattccatgcggcctgatcttttttaaatgaacctgcattgggtttggataaccctttagtcccggcattaaaagggcggtgtcctttgcaaaactggccactacggccagtacgtagtcccagtctttttctgaggccattaatggcttcatttgaacggttgacagcaaaatgctgattaaaacgcgccgtgagtttgcctaatggccgcaggtagttggctttcatccagctttccatttcagcggtatactcaaatcgctggatcattatcttccctccagatatttaggcgcggacttgatttcctgattacccagtgccttctgaacatcaaaagccagtttcccgttgccgatgatttgggtggccacacccgaagtggcttttgcacgacgaatttcggtctctaactgttcaccggaaagatcttcgtcagacaaccgctctaactgagcaaaaagatggttattcaaatcttcaagggtatttttcatgatgtttccccgcttaatgcacttggccgtgagggatgcctgattccagtacgcccttcaacgtattttttaatttctccagctcaattttttcctttggggctggatccgcagataaatcggatgaccatgtcacttcaaaccggttgatttcttcgttataaaagagaatggtttctaactttgcagccattatgtcctcctcaatgcccggcgtaccggacacggtttgattaacggtttgttagcgaacctgtaaacttctttccccaatttcgatatgcgcacccggaacggtttcaccgcgttcgatagcgtcctttatcgctttcttgtccggggcgataagggtttgaacgtccaccagctcatcgggcagcaacatttcgttatcgataatgatcttggctacacacgggcgcacactaaaggtatttttagtggtcttaaggctattcagatcagccttcagcaaacaatccagcgcatatttcttgaggtgtttggcggttctgtcgcattaacggaacttcaggtaaacttcccggtttttgcgcgggttccaaacgatgcccctgagccgaaacgcctttaaacgtctccattatcccgtcgatatcattgctcaatgtgtccgttggtatttggcctacgccctgagtttgcgtaacttagaggaaatgatggttgaacgggggattgccgttgatcattctaccctttcccgttgggttcatcgtctggttccgttgcttgtgaaacgttatcggcggtgcaagcctgatgttgggcatcgctggtgaatggatgaaaccgatatcaaaatcaaaggtcaatggaaatatttgtatcgagctgtggactcagacggcaagacagtggattttttgttgacggctcgtcgggataagtcgtcggccttgcgtttcttcaaaaaggcgatgcgtcagcatggccaaccggacgtggtgacaatggataaaagtggcgccaataaagccgcagtggatgaattaaatcaaggaaagccaaaagaggaagccattgttatccggcaaaacaaatacctcaataatctgattgaacaggatcaccgcaacatcaaacggcgaatacatcccatgctgggatttaaacatttccggcgagctcaaacgttattgagcggtattgaattggtcagtatgttacgtaaaggacaatatccgcaagaaccagagtgttttctttcacccgccgactttttctatcaattggctgcataaaaaacaattacatcattttctcttgctagcgctctgttaatgcgacagaaccacatttcgtatgcacaatatatcgcggttgtttagccagcgggatacatgcatcaaaatggctcattatttctttttcgatatcgttactataggaatttaaaaaccacctcattaaaacaccccaagtttttaaaaaaatgtttccttattcagtattaaaaaatacagggtggtaaagtgtttaaagttcacaataaactgctgatttactgtttataggaataaaccgtgaatcgtaataagcatcgagccacactatggtggctcgatacggttatattgttggtggatatcggttatattgttgggaactttttgatttgataatgttttgaactgtatcaataacaggttcattattatcgtcaataaaaaagtgagtaccttcaaaaatgatgacctttttctcttgttcaaataaatctaaccaagaatagagttcttgctctgtgactatggcatcattttttccaccaaacacggttaaagtacaggagaaagattctgttccaacataatgatattcttccgaaattttaaaatccgcctttattgcgggtaaaatcagggacaataattcggcattgtcgatgacttgtttatcaacccggccaaacgtctgtaatccattgataaaatctttatccggtaacccacttaatggttctctgatagcaggaacctggggccctttactgcctgaggcaataaattcgatggggagaggtaatgatgctgcgttaatttttcttattagttcaaaagcgactcggctacctaaactgtgaccaaaaaatagataaggtttattaagtaagcttttaatattgacatagatgtcttcaacaaggtggctcatgtcattatgaggtttttctctgatcctgctgcctttaccggggggttgtatgactaaaaactcagcgtttgttttgatttttttggcaaagggaacaaaagttgcactgcttcctccggcataagggaaacaaaatattcgtatctcaggattagaaacagtattaagtttaataaaacatgaaggagatttttctatcacaatcgggctccgttatcttttgctataaagttacgcattgaaattaactattctgataacttttgctttttgtttacggtatgttaccgcccttgggtattatcccaacattcaaacaacgatgtgtctgtcagttaaaaataacgagtgataacaaatgaaaataataattaattctgaaaagttagagtggtgtgatattagcacattgcaataaaaatcaatggattccttttttgattcacttatacatattaaaacagtccgttattaatttttattacagacattatatttaatggagtagggttatgggtatttatgttattaataacagaagtgattgatttatttttaatggtgtccatgaggaaatatatgaaaataacaaaataaattcaactatatatttattttaatggagtatttaattggctggttgtttttcaagtgaaataatgctgtgttaatatattaattatggaaaaataagtgacctaaaattttagcaagcttcaggaagctgactttgtgcgctatggtttgtttgcttagtatgaaacatgagagttacctcctttatttttgactgatgttttcctcttttaatcaaagttggcaactctcttctttgcaaatcgaagtgttagattgggtctgaacgacgacatctaaacactaccggtttttcaaaattaattttatggctaagagaacgttttaactggccactctctattcgttttagtcacagacacaagagtcacttttccggtagtccgatgataaattgctgatacatcttttgatattgaaggtttctttatggtattcccatgccagagacattctagttttccgtcagaatgtttccggcaaagatgtataggcccgcctctatgagggcatttatcatcgagggcaattattttactattttcaatataaacgactgatcttttattttctgccgggaaattaataagtaatgccccgctatagtctattttttttaattcccatttagttaagtctcctaatggtgtatatttcataatcacaagattctgatttaattaaagcaccatgtaaccgattatgttcgataataattccttctccagcatttaaaattgtagatttttcaaaaccatttaaaaactccatcgttcctgatttaacatgacataactcattactatcatgagagtgagttattgaaactatggatgggccgggnaattttacacaagggataaaccttatttgtggcttcctttacttttaatgatgattctatatggangatgttatattgtttcagcattatccttccattctatctgacgtataaaatcttgttcgctgatatcactgattaaacatgcttcttcgaatcctctaatgatctctgttgctgcaatttggccatatttatctatagccggtgagactaatccttcaaataccattcttgaatggtcaatgtctatgtgacaatgctcattaaaatatttgacattaatatttggcaatgcttcttttaatgcgtttttccaaattttacaactcgtaatgaaagacgtttctgcttgataagttgcgccaatataacgaaaagattgtcttttgtcttttgttaccatattataataatttgctaatagtaagctgccattaagataatattgccagtagtaatgaggtgtagaatttaaattaacagaattaagcgtgtctcggtataatgttgcgtgatgtttagaaaaatcaccataaccgagttcatcaataattatcttgaataaagaactggcaatttccccatagcttccactggcatatctagccatagggcttgattcaattaagaaatctgtggccaattgaattagccaatcttttgatgtagtaataggatctttcgaagttaaaattgcattggcagatgggagagatgagcattttaatgattcatctgcgaatgagaaaaatattctttaactctttctttattccagttttcagtaataatgatttcatcattaaggaatgaaaacagatatttttccaaaagcctaatgcctgcattagaagtaataaagcgctcatcagaataaaatttttgatagtcttcccagatgaatttatccatttcaggaagcattaaaaaatccatttcattcatggtaaaaagagttctatttgcagcgaatgcactatatgttaagatattatctctggttaaaggactcgaaagatcaatatatttaaggacgtgtggtcttattcttcgaccataaaattgttcttcgtagcgatttccgttatcaatacattgttctgaatcagcaaatgcaagaatagcatctctacctatattaatgtcgttgaaattttcaatttttttataatcacgtataagttttttattcattttaaaactcctcaagtatgaattttccgtcacgttccagcgatccataatattgcttatattttaaaactttctttggcgtatttaagggatgaaatgcctgatgccaatggctttgtaagccggctttatttgaaacatagaatgatccaaatttggcaacaaagaaagacaacatgccataacaaataccttcttcatttattgagaatgtcgaagtttctgttgttgaaatctcggttaaatagtcatagttttttatatttgtgagaggggttagcaatttattttcgtaaagatgggatctgacaggaaagaaattttttgtgctataacgattaagtggcgatagatccaggcctttaataatagcaacattattgaggctgtatatttctttactctctacaagatagccatattgctctatcttataaggcatgattattgtttgtggttgtgcgatttttttaatatcttctgaaatactatagaaaccttcacctatgacgccacaatcaatagtttcagtgaatataatatctggcgtaaaatcaagatctccatcatctataactttggaacttgacttgtttattaaagtaatacacttatcgaggttatttaatttaaatattgcgattgcctctttcgatagttgctcatttatttcgcaagttaatacttttttagcgccatattttgcaaacatcattgatattaaccctgcgccagtaccaatttcaaaaacatttttaccatttagattcaattccttaatggcactttctaaagctattgtcctcgcattatcatttaacatggagtaatgccaagtatcaaatgacctcacgctactattaagcatgatagtactccttacctattaactaatgcatttttttataaatatctaatttttatttttcattttaagactaattaaatttgttatgagtagtaataaattttcataccctttttttgcaaataaataatgatatcttgcgcgtaaacaaccatgtatcgcttcatcttcaatattgacataaacattaatcccgttttgtttcatgcgatctgatagtgttctgacgtcatcagacaacgggtcaatggcagcagaccaaaatacagcaggaggtaatccggaaagattatcagcgagtaacggagatgcgtattggatgagtttcttttcattttggccaagatatgatgtggtaaaaaaatgcatttcatcacagaatgctttagatacatcgctgactttcttttgagcccatcggtgaacatccaatacagggttgattgcaatggagccggccagttgtggtagattattatctcgtagccaaaggggtaatgctatcgcccagtttccaccgcagctctcaccagcaaaataaatttggtcaatattgatgcctttttgttttgcaatctgacgtatgaaaagataaacatcacaacaatcttcaagggcagcaggatatggatgctcaggggcgagacggtaattaaaagccacgactctgacattaagatcaagtgctaaatctctacccatagcatcaacaacactcagatcaccacttacaaaaccactaccgtgagcatagataatacagggtaaaatttgctttgattcaagctgttcattaggcgaatgaattcgcatatcaagtattttgtctgttactgaacttttgaattgcagatcttcagaaacagttccatctcgtggctttggggggaaccgcgaaaatagtgctttataagaagatctaacataatcaatacttttaaagtaaaaatcggtatccattacgtttgagcatgtgtactcgtagtctttcatagattgtgtcagtttggctctcatttattaatcctttttgttaaatgtaacaatattgttataaatccgaaagacacctaaaacacactgttttttgctctttagcttttagaaagttcaaatttttgaatttgaaagcaagaaatagggtgtgtgtctatcgagtttatctttaggatgttaaaaaacaggcaaatcttggtgagagggatctttatttaggtatttaatctaacgatattaggtcgatggagtaaaataaaagggtagtagaaagttctgaggtatcctattaaataattaaggaacttaattatgtcttggagcaaagataatactctattaactgaattagatccccgttggttggatataaaggcgaaaaacatcaaagctgacggccacttcgtctacgccgttaaaacaacaggaatttattgccgtccatcctgtccgacgagaattcctaagcttcatcacatcgagatttttgataattgtgaatttgctgaaaataaaaactatcgcgcctgtaaacgatgtaatcccaatggtgaatcaatttcaacaaaaaatgaacgcttagtgacaaaggcgtgtaggattatagaaaacagaaggggagatataaaacttgaggaactctcaatgcaggtagaaataagtgcctattttttccaccgtctgtttaagaagatcattggtgtgacgccaaaacaatatagtaccgctattcgtattaagaatatgcataacgaattgattaacaaaaatgaaagtataacaaatgctatatacaattccggttttaattcttgtagccgattttatgcggcaacggataattcattaggtatgacgcccagtgtctatcggaaaggtggcaaggatactttaattcaattttctattaccgagtgctcactaggaactattttagtcgcccgttcattgaaagggatttgcgctatttcatttggtgataatccaacagaacttcttaatagtctccaagataaattttctaaagctgaatttattggcggcgacttagattttgagaatgtagttgcaaaggttattgagcttgttgaaaaaccaggcattctatttaaccttccactggatattcaaggcacagtttttcaacaacgtgtatggaaaatgcttctcactattccgactggaacgacgattagctatacccaattagccgaaatgatcggtaatccgggggctgtgcgtgctgttgcgaatgcgtgtggccagaattcaattgctgttgctattccttgtcaccgggtcgttaaattggatggcgatatttcaggatatcgctgggggattgaacgtaaacgcttattacttgatcgggaagctgcggagtgaaaatgaataacattgatttgtttccttatatatcggattaattttttagataacggattaaaactggacacccgttttataacaggtgttcagtaaaaatatattaaataaataactgtcatcttaataatgaaaaatagttatcaggtgataaccaaaatatattacatgacgtggggtagccttacgcctcatcccgctatgcccctgaatggcacaatcaaaaatagccactatatttaatggcaattgccaagtcacactgagtttattttgtcagtttgagtagggatagagtaaggagaaggtcatgaaggtattgatagcaaagaacgaagtgggtacacgatatcacagtcattatattgaaaatgccgtacaccggttggcggataaattaaccgaccgagatgttgaggtggttattgcagactcatttgatgatagttacacgataattgcatccaatgagccgttcgattgcttaatggtcagttgcgcattgatggatgatgatttatatcgagaaatacagcgattattaaataaattgtttgaacgccaggaaaatgtgccggtatttttattaagtgatcgggaaaaaaccgtatttctgctaaatcatgaattgctggaacagttgactgaatttgcatggatacttgaagactctgctgatttcattgcaggcagggcaattgcggcaatgcagcgttatcgtcaacaattattaccgcctttgatggccgctttaatgaaatacagccaaatctatgagtattcttgggcagcgccggggcatcagggtggagtcgggtttaataaaaccccagttggtcgtctttatcatgactattatggcgaaaatctctttcgtaccgatatgggaattgagcgcgcttcgttgggatcgctattagatcactccggcgcatttggcgaaagtgaaaaaaatgcggccagagtctttggcgctgatcactcttattccgttgtggtaggaacatcaggctctaaccgcacgattatgcaagcctgcatgaccgaagatgatgttgttatcattgaccgcaactgccataaatccatcgaacaggggcttattctgacaggcgcaaagcccgtctatctgctaccgagccgcaatcgttatggcatcattggtcccatctatccgcaggaaatgcagacaaaaacactccagaaaaaactgaaacagaacccactgactcaagacatggctagccgtaaacctgcctatagtgtcgtgacaaactgtacctatgatggtgtctgttataacgccaagcatgtacaggaattgctggctaaaagtgttgataggatacattttgatgaagcatggtacggttatgcgcgttttaacccgatttaccatgatcattatgcgatgcgtggtaatccgaaggatcatgcagggccgactgtttttgccacccattcatcccataagttgctgaatgccttatcacaagcctctttcattcatgtgcgggatggtcggaatcccgttgatttttcaagatttaatcaagcctatatgatgcatgcgacgacttctccgctctatgcgatttgcgcctcaaacgatatcgcggtttccatgatggacggcaatagcggttattctttgacgcaagaagtgattgaggaagcggtagactttcgtcaggcattggctcgcttgcatcgcgatttcaacgaaaagggcgattggttttttaaaccgtggaatcaggaaaaagtcaccgatcccgcgacaggcaaaaaaattgcgtttgaagatgccccaagagatttactgaccaaagaacaaagttgctggactatgcgcccaggagacagttggcacggttttgaagacttgcccgatgactggagtatgcttgatccaatcaaagtcagtatcttggtgccgggcatgggagataatggtcaattgctgaagcggggtgtgccagcggcgctggtgacagcctggttaagccagcatggtatagtaccaacccgaactaccgattttcaaattatgtttctgttttcaatggggattaccaaaggaaaatggggaacattgctcaataccttactttctttcaaacatcattacgacgccaatacgcctctcagtaaggttttacctgagctggtaaatcaacatcaggaagtctatggcaatttaggtttgcaagagttgggcgataaaatgtttgcttatttgcatcagaataatccgggcgataagttgaatcacgcgtattccggtctgccggaaatggcgatgacccctcgaacagcttatcaggccattgtgaccaacaacgtcgaaatggtagcgatcgacgatcttcctcaccgtatcgcggccaactccatcattccatatcctcccggcattccgatgttgctttcaggggaaaacttcggagataaaaccagcccgcaaataggttacttacatgccctgcaaaaatgggatcacgaatttcccggatttgagcatgaaacggaaggaacagaggttatcaacggtatttatcacgttatgtgcataaaaaaatgagaacgggaaactaaattatgactacggtttcagagatgaaaaaagtcggattgatccccgttacgttgatggttgcgggcaatatcatgggatcaggcgtttttctcctgcccgccagcctggcttccaccggaggcattgccattctcggatggctggtcacgatcatcggtgcggtggggctatctatggtgtatgccaagatctcttcactggatgatagcccgggggggtcttatgcctatgctcgacgtgcctttgggccatttttgggctaccagaccaacgtcctgtactggctggcctgttggatcggcaatatcgcgatggtggtgattggcgtcggttatctcagttacttttttgctatcctgaaagacccgatcattctgaccatgacttgcatcgcgatactgtgggtatttgtcttcttgaatattatcgggccgcatgtcattaccagagtacaggctgttgctacaacattggcacttatcccgatcgtggcgacggcggtattcggctggttctggttcagcggtaaaacgtatatggatgcgtggaacgtgagcgggctaaatacctttggggctatccaaagtattttaaacgtgacgttatggtctttcattggggttgaaagtgcctcggttgccgcgggtgtggtcaaaaaccccaaacgcaacgtgcctatcgcgaccatcgggggtgtacttatcgctgccgtatgctacatcttgtccagcagcgtgattatgggcatgatcccgaatgccgcgctgaaactctcatcttcgccttttggtgatgcggcgagactggcactgggtgataccgcaggagcgatagtcgtattttgtgcggcggtagggtgtttaggatcactgggcggttggacgttgctcgctggacagaccgctaaggctgccgccgatgatggtctgtttcctgctatttttggcaaagtgaacaaggagggaaccccggttgctggcctgctgatcctcggtgtattgatgactctcttccaattcagtagcatttccccgaatgcggcgaaagagtttgggctggtctcttctgtttcagtcatttttaccctgataccctatctgtatacctgcgcagccctgctgttactggggcatggacatttcagacaggaaaaaccgcgctacatagtgatcacttttattgcctttgcctactgtatttgggccgtgatgggaacaggcgctgaacaagttgtatggacgctggttgtgatgatgatcgtcacggctatgtatacttttaactacaacacaaagcatcctgctcctttcccattggagaaaaatgattaacgtcagtttgctggtatcacagggggctgaaatatcagccccttttttgtgcctattgtcggctggtttgtcgatttttcgacgcaattgtgcatgaagtcagtaactattcctgctaatttcacatcaagatcgatttgtgataaaactcaccttttgatgtaacaagccacccgccgtttgtttaaaaaatcaacatttctggagaaacaaacaaatgtttgtttagttctgttctttatcaatatgattgtttttattgttattataacttaaataaattattactggttcgactaataagaattaaattccttactattgtaaattataagttaattaaacgtgatttatgtcaaatttatccaatgtgaaaagcctttcatgagacttacgatctctttcccataatgacaacaaataatgtaaatgcactttactgcctgccagtgatgccatagaaaagtctcatgttcaaaacataagtaaggacatgaaatggcgaatcgggaaaaacagatattgcacctcctcaggcgagatccttttattcagcagcaagaaattgccgatattcttggaattagccgttcatgtgttgcggggcatattatgaacctgagcaagaaggggcatataaaaggtaaaggctatattctgtctgacaataggtattctgttacggttggtgcagccaatatggatgttaccagctatgcattcgcagaattaatctatgaagattctaatccggggaaaattcaatccacggcgggtggcgttggccgcaatattgcccataacatcgctttattaggcagtgaaagctatttaatttctgttattggtaatgatttttatggcaaaacattattcgaacagacgaagttagcgggtgtttatgttgattatttccataaattatatggtgaaacgacatcaacctacaattcagtgattgatgacagcggagaaatgcgattagccattaatgacatgaatattctggaaaaacttacgcctgccttattatctcaatccaaagccttaatccagaatgcaggtgtattgattattgactgtaatttgacggaagaatcattagagtggctattcagtcatgccggaaatatcccaatctttgttgatacggtatcaacattcaaagccacgaaaattcgccattggttatcgcatatccataccctgaaacccaatcgatttgaagcagaaatactcagcggaatcaaaattgtcacattggcagatgcggctgacaccgcaacctggttccatcagcaaggtgttcagaggctggctctgagcatgggaacagcaggcgtatattacagtgaaatagcgggaatcgcggattgctcacctgccatttccatcaacattgtcaatgccaatggtgcgggagatgcaatgatggcggggcttgcccattgctggctggaaggcatgacattggaagacagcattcgtttcgcacaagggtgctctgcgctcaccttgtcctcagaactgaccaatcaccccaatttatcccttggtagagtgaaaaaactgttggaattaaaatcatgaaaaataatcttgtcttaaatgaatacttggatatttctccggaagtagcacatgctttggctgataatcggcctgtcgtggcgctggaatccactattattgctcatggtatgccttatccgcaaaacgtggaaacggcgctggaagttgaaaactgtatccgggaacatggggcagttccggcgaccattgcgattattaatggacgcatgaaagcaggattatttcaggaagacattgagttgttggggaaagagcggcatttagttgcaaaagtcagccgccgtgatctgccgtttgtcgtggcagaggggaaacacggggcgacaaccgtggcttcaacgatgattattgccgaaatggccggcattgccgtatttgcgacgggagggattggtggcgttcatcgtggtgctgaacacacttttgatatttcagccgatttgcaggaattagcgattaccaacgtggcagtagtgtgtgcgggtgccaaatccattcttgatttgggattaacgaccgaatatctggaaacacatggcgtgccactcgtaggatatcaaaccgaaaaattgccggcatttttctgccgtaccagcccatttccggtgagtgtgacgcttgaaaatccccaacagatagcccatgcgatgaaagcaaaatggaattcggggctgagaggaggactggtgatcgccaaccccacccctgagccattcgctatgccggaagctcaaatcaatgcagctattgaacaggctgtccgagaagcgcaggagcaggggattcatggcaaagagagtactccattcctgctgaccagagtatcggaattgacgggcggtgaaagtttacaggcaaatatcgaactggttttcaataatgcgaaactggcagcgcaaattgccattgcttatcaagcaataaataagcaccagtaaatatcatccgatatatcttatccaacgttacaataaaataagtgccagcctgaaagaaaacagggtaatatcccttgggatttttttaggctggctaaaaaacaatggaaatataatgatggatattttacgcagtttaatgggaatagtaatacttcttctggttggatatttgttctctgtcaataaaaaaagaattagcttgcgtacggtgggcgctgcattattgtttcaagtcagccttggcgcaataatgctgtatattcccgccggtaaatggttaattaataacattgccaatggcgttaatgccgttatttcttatagttccgctggcagttcatttatcttcgggagtttagttgggccgaaaatgaatgaattatttgatggagcagggtttgttttcgcatttcaggtactgcccgctattatctttattacttctttgatatctattctttattatattgggatcatgaaatgggtcattaatattttgggatatgcttttcagaaagcgatgcgaattagtaaagtggaagcctttgctgcagtaaccacaatctttctggggcaaaatgaattacctgcggtgttaaaaccttttgtcaataaaatgaaccgcaatgagcttttcactgtgatatgcagtggtatggcctcaattgccggatcgatgctggtgggttatgcaggattgggcgtaccgatagaatatctgttggcggcatctttgatggctattccgggagggattctgtttgctcgtttgctcagtcctgccacggagccttcacaagtacagtttgaacagatctcattcagtgagacgcgtccggccagcattatcgaagcggctgccggaggtgccatgttaggattgaaaattgctgttggcgtcgcgacggtggtgatgacatttgttgccctgatagcgctgatcaatggcatgatcggtagcattggcgagttattcggcctgacggggctgagtatgcagagcctgctgggttatcttttttcgcctttggcttatatcatgggggttaactgggagcatactgatctggcagggagtttgattggacaaaaattagcaatcaacgaatttgtggcttatgtgaacttttctccttatttaaaagatcctacggttcttctggataccaaaactatcgcggttatttcgttcgcgctttgtggctttgccaattttggttcgatagcggttgttgtcggtgcatttacagcggtagtacccgaaagagcttcagacattgcaaggctgggtctgagggcactactggcagcaacactgtccaatctgatgagtgcaacaattgccggcttgttcattaatttggcaggttaaacgcctatctattaaccgctatcggcgctaacatgttgaggtgttagataactcacagtaagttatgctggatccctgtaccatcgggaaatcaactaggcttggtatttgaataataggagcgtgcatatgtacagaactattttagtaccggtagatatttcagaagaagaactaacgagtaaggctgttcgctgtgcgcttgatatcgccagagaaacaggtgctaagttacatattctacatgtactccctatttcatccgcaattattaatgcttatgcattaggctatatggaaattaaagacaaagcgaccgtcaaggccgaagaggaattggctatgctggtagattccattgatttaccgaacgatcgcatttcctattcaatttcttttggctcaccacgagacgaaattacctccacggctgatgagattgaagccgatttgatcgtcattggttcaaggcggccgaatattacgacccatctgttaggttctaactcggcggggattgtcagatatgcgaaaacctctgtattagttgtgagataacatgggttattggcaataatggattaatgattgttactgttttttatggcggcttgattacttagaaaagcgtaatggccagtagttacattcgattgcaggggagtatgtatgtataaaacgattttagttccaatagatattccagaagatcaactcactgataatgcgattaaacatgcagaatttttggcaaaaatctccggtgcaaaaattcacctgtttcacgcagttccggatatctcaaggttttctgtaaattacagctatcactatgatttgctgagtgcttttgctaaaaaagccgttacaaattctgaagaggaactcaaaaaagtcgtagaaaaaatcaatttaccgaaagatagagtatcgttctccgttgcttttggttctccacgagataaagtactctccactgcccgtgaaattggcgcagatttgatcatcgtaggttcaaggtggcctgatatttcaacccatttactgggctcaaatgcgtcgggcattgtttcctacgctaatatctcggtattggttgttcgataactatctggtaatatgcctaaaaccgtgcagggaattgcacggttatttatttatgcctggtcagtaaatgaattcagagtgatatctaactgatttttaccagcaatgataacttgaatttgtaagttattttctgagctgttagtcgtaattacagtcacttcttcattccctgaatattttcttaccactgccagcaactcttgctcaagctgctcaattttagtgctaatagtcatttattccgttaaattcaattaaatattattaagttggtttaatgttactcaaataattagagttcaatagtttaataaacgtgatattttggcatttaacatgggaataaatccgctaattttatgaattaagtaatattaatattaactaagccaaataatggatgggtttaacaataaatattaatacacactcgacgaataatatttgtcatgttattgccttgtcaggcaggatagggcgaatgttatacacaataagtaaataggtatcattttgaatagtaaaattagcctgtgggcaagttatcttttgttttttggattaaccgtatcttttcatgcattgagtgcgccggccagctttgagcaggcgaaaatagaatcaagaaaaaatgtctatagtggacaaaccaaatcagcaattggcacattgtattgcggttgtgactggcaatgggtaggtaagagtggcgggcgtgttgatctggcatcttgcggctatcaggtcaggtcacagcagtcacgtgcggaacgtattgaatgggaacatatggtgccggcatgggtctttgggcatcagcggcagtgctggcagaatggcgggagaaaaaattgcgttgagaatgatccgttttttcgcgtaatagaatcggatatgcacaatctggcgccttcgattggtgaagtgaatggtgatcgcagtaatttcagttacggaatggttcctggaaatatggcaaatatgtatggggcatgcagtagtaaagtcgatttcaaatcacgcctgtttgaaccgcgcgatagagtgaaaggcgtggttgccagagtttacttttatatgcacgatcgttataaccttgcgatgtctcgtcaacagcagcaactgatgatggcatgggatcgccaatatccagtagatgggtgggaacgggaaagagataataaaatcgcccggatcatggggcaccataacccatttgttactggtagccagaaatgggaactggggcataaaaattcaggtcagggactgagcactcaaaatggtgtccaaaagcaaaatagctttcaagcggctggcaatcaggctctagccagaaacccgaccgtaaaaaccgcgcagagtgaaaaaattaaaggcaacaagaatagccagatttatcatcttgcccactgttctggttacaaaaccatagccgataaaaacgcggtctattttggaacagaagccgaagctaaaaaagcgggatatcgtctggcgagtcattgtaaaaagtaaccagaaaatgcaggattgttaatttttcacgatgactgagtaatcctttatcaaagaaaagttaaaaaacgtttcagtaaaatttaggcttttatcttgtcataaataaaaaactgtcattatactgacatcatagtccgttaggttacattacagcagaaatgaaatgagcgagtaatgctaatgacaggtactgaaactgtatttcagttaggaattgaaccggtgattgagatctgagccaccaataaaaaggtggcgatcttagcgccggttttttcatgggccttaatgagctgaaaaggaagctccatgtatctgttttatataacgcagttattctatgatgatagaacaccgcaagtgtgaagccaacgataaggtgtgcgactatgggtagacagaaaacagtgattaaatctcgtcgtgaagtcaggagaatgttaaaaaaagacctgcgccagtcacgttatcgcaatgatgataatgtgacttcattggtgccgattggcggagtggaggctattggaatggcgcgtgagaacagggatacttctgaaattcgtccacataatgaaatgcagcatcgctatatgtgggcaattaataataagcagttagttattgccaatggtgcagcgggttgcggtaaaacgtttatcagtaccgttatggcggctgatgcgttaatcaataaagagattgataaaatcattgtaacgcgtccggtattgcaggcagaagaagatctcggctttctgccgggcgacatggctgaaaagtttgcaccttattttcgtccggtttatgacgttttattaaaacggatgggcgcttcgtttttacaatattgtctgcgccctgaaatagggaaagtagagatagccccttttgcttacatgcgcggcagaacatttgaaaatgcgtttgtgatccttgatgaagcgcagaatgtgacagtcaatcaaatgaaaatgtttttaacccggctgggagaaaatgttaccgtaattgttaatggtgatgtgagccagtgtgacttgccggagtgtattacatccgggctgatggatgcactggagcggttttctgatgatgaagcgattagtgtgattcatttttctcaggaagactgtgttcgttccagattgtgtcagaaagcattgctggcttatcgttgatagtgactgaagcattttatcagcagaagtcttagcattaattatttactttaatgaagcctaatagtcgtttttatttttttatattactcagctcatcttgcagcggaaattgaatttcaatttctgtgccgccttttttgcgttttttgatttttatttgccctgaaatgagagtgacccgttcccgcatgatagcgagaccaaattgagccttaatttgctcctgatggatgccgcggccattatcactgataaccgtgataatatttttgcctatcggatagatgcgaatactgatccaactcgcgtcagcatgtttataacagttatttaaggcctcacgaataatctgcgccaaatgacggcggtggccgataggaataatctggtgagtaagccgataataaaattcaatctggaatcccagccgatgattgaatccttttatcagggattgcagggattcatacaggtcataatggtttttttctgcccgcaatgtggccagcatttcccttaattgctgactggctaaagttatctcctcttttatgatccgcaaggcgattaaggcctgtcgggagaatttatcgtggcgcacatgcaggctgttaatctgaattttcagaaatagaaatgattgtgccactgtgtcatgtaattctctggaaatattttcccgttcattgataagcccctgctgaatttgctgatgcacggtatttttcagagacaggtgttttgccagcgcatccgtaacagactggatcagatcccgttcataagaagacagaatctgagtttgattaatcttgatttgaattatgccgtgaaaagtatgcctgtcatataaatcccatttttgtatccgaggaagattgacgtcaaaggggctacggggatattcaaaatgatacttacgcggtggatgataaagcgtgatcctgacttcgccaaaggggatgaattggttaagtctgaaaaataccctataaaaattatcagagagtgaagtattaagattgagttgagaatggacggagataagaaaacgcaggtattgtctatcccgtttcaagacagttatctttctctgttttatcttacaaaatgatgccacctggagcgaaatcatatcggctttatacagcaagcttaaaaggcacaggatactcaggatatcaaagatgacccacagctttccgggcaaggtgagcggggtattcaaaccaagaaatagcagcacagacaaattgatggtgatggctgcgccacataaccagcctgttgctgctattggactgtcagagaaagttttcatcagttaaacaatccttccgttttcctgatcaaaaccttagctcaattaattaaaataggttaattatcacttaactttcattcccgctgttgtcattaagacacgaaatagcgaagaggcggcgtaaagtgccagcacactgccaagccagatggtgaccagccaacccagccgtttccagagggaagggcggggaggatcggactcagtgataaccttgttcatgggtgatttttcctcggaagacataataactccaaaaggtgtagaccagtatgattgggatgatgaacagggcgccgaccagcataaagcccagtgattgcggtggggcggccgcttcttgataaccaatcatcggcgggatgatatttggccagatactgatccctaatccactgaaccccatgaatatcagcagtaatgcagccagaaatggggtgtaatggctggtgttctcgttagcttgcaggagcttccagcttgaccctataacgagtagcggtacgggtataaagaacagcaaattaggcaggctgaaccagcgttcggcaatggcttgatgtgcgatgggggtccagaggctgataatgctgatgacggccagcatcagccgcgtcagcgggcgcagaatgcgatacatctgctgttgcaggtggccttcggttttcatcaccagccagccacatcccagcaacgcataagcgacaaccagaccaaagccgcagaatagcgggaatggggcaaaccaatcgaaagcccctccaatataggtgcggttctcgaccggaaagccttcaatcaccgcgccaaccaccattccttgcgtaaaagtggcgatgattgaaccagaaataaatgctttgtcccagatgtgctgatgttctggcgtggctttaaaacgaaactcaaaagcgacaccacggaatatcagccctaagagcatgatagtcagcgggattgccagtgcatccaagatcaccgcatacgccaaaggaaaagcgccgaacagcgccgccccgcccagcaccagccaagtttcattgccatcccagaccggtgctacggaattcatcattaaatcgcggtctgactgccccttcatcataggatacaaaatgccgatgccgaggtcaaaaccgtccatcacgatgtacatcatggtactgaatataatgatcagaaaccaaatcaggggaagatcaatgcccatttgttaactccttgttggggcctttgcggatcagtttcatcatataggcgtaaccaacaccaaagacggcagcataaacgacgaagaaaataagcaggctgatgctcatgtggatctcgccatgtgccgataccgcatctttggtacgcattaagccatatacaacccacggctggcggccaatctccgtggtaaaccaaccggccagaatggcgataagacccgaaggtgccattaagaatataaaccggagaaacgtcctgttttcatataatcgctttttgtaacgtagtaacaatccccaaacgcccgccacaatcatcaatattcccagcccaaccatgacacgaaatgaccagaacatcataaagacattggggcgatcttcgggtgcaaattctttcaatgccggaacctgtttatccgtactgtgtgtcaggatcaggctggcaagataaggaattttgacggcatagcgagtttcttctgcttcctgatttggaatgccgaagaggatcagcggagtagcttcgccgggacggttttcccaatgcccctccattgcggcaactttggctggctgatatttcagggtattcaagccatgaaaatcaccaatgatggcttgcaacggggcgatgatcagaatcagccacattgccattgacagcattttcttcatggcggaggaatcattgcctttcagcaggtgccacgcagcggaggcggcaatgaagaacgctgatgcgagaaacgcagcggttcccatatgcagtagacgataaggaaaggaggggttgaaaatcacggcaaaccagtcaacaggaacgatttgattattgatgatttcatggccctgcggtgtctgcatccaactgttggaggccaagatccagaatgtggagataattgtaccgagggcaaccatgcaagtagcgaaaaaatgcagcctttcgccaacccgactccagccaaacagcatgacgccaagaaatcctgcttcaaggaaaaacgcggtcaacacttcatagactagcaacgggcccgtaatactgccggcaaattcggagaaaaaactccagttggtgccgaattgataggccatcactaaaccagaaactactcccataccgaaattaactgcaaaaattttcgaccagaagtggtataacgttttgtagtctgtattgcgtgtctttagccatagcccttccaataaggctagaaaactggccaggcctatcgtaatggcaggaaaaataatgtgaaaagaaatcgtgaaggcaaactgtatccttgcgagttcaagggcacttaacccaaacatagtgacctcttattttagttgaatcatatggggcgatgaagttagaaggtgcggataagtaaaacacaggaatttagggtataatagtgacaatcatctatttattacctataacagttttaccaaaggtcaggcgatatgacacgttacgaacaattggctggggcgatccgccagcaaatagaggatgatatttggcaggtgggcgacaaattgccatcactgcgggaatcggtgaaatcatcaggattaagcttgatgacggtgctgcaagcctatcaattgctggaaagtcagggttggatcgtggctcgtccgcaatctggctattatgtagccactcggttaacgcaatttgcggcagcgaaaggcggaaaaggcctgcatttaagcgaaagtgtagagatcagcgcctctatttttgatgtgttgcaggcgtgcaaagaccccaaaatcgtgccttttggctcggcatttcccgatccttccctactgaacgagccaaaattatccaaaatactggcctcagttgcccgtcgctttgttcctcatagttcgttggagaatttgccgcctggcaatgagaagttgcggcgtaatatttcccgtcgttatgccgcccacggcattcatgtgtctcctgatgagatcgtgatcactgcgggggcaatggaatcattaagttttagcctacaatccgtgacctcaccgggagattgggtggtgattgaatcgcccgctttttatggtgcgttgcaggccatagagcgcctgcgcctgaaagctatcgcgattaaaaccgatccgcggacaggcattgatttggatgcactggaagagatcgtgcagaaatacccgataaaagcttgctggttgatgtctcgtttccaaaatccattgtgcaacacgatgccatctgaaaataaacagcggctggtggagattttgaatagtagtcatattgccctgattgaagatgatgtttatggtgaactgtatttcgatcaagaaccgccgatgccaatcaaagcatgggataaagaaaataatttcatgcactgttcatcattttcaaaatgccttgctcccggatatcgcgtgggctgggttgcagcaggcaagcacgcagggaaaattcagcaattgcagatgatgagcacggtttcagccagcgcaccaacacaattggcggttgcggaatatctggctcacgggggatatgataaccacctgcggcggctgcggcgtcagttggaacagcggcaaagtcaggttttacgggcgatcagtgaatattttcctgactcggtgaaagtgaacagtgcacgtggcggttatttcctgtggctggagtttgaaccgcctttcaatgctaaccggttgtatcgactggcgctggccaaagggatcagtattgctccgggcagcatgttttctaccagttctcagtttgatcacgcctttcgcttgaacacgtcatttgcatggaatgacgtgcaggcttcagcaatgaaaactttggcagacttgtgtcatacgctattaagggaatgcgggtaatcaatcacatttcaattatctctatgttgtcgtaggcagaattatttgcgaatgttggagttaacaattcgacgttaaccgtcttctgggaatatacacagggcttaagagtggtgaggaggtggcatgaaaatgaaatatttcgattatgcaacgttaccaagaacgcaatggtcaggcgggacaggcgaaacaagggacattgtctgttggccagtttctgatgatttcgcctggcgggcctgtttcacgtcaatttatgaaagtgaagtattggggcagtttcctgatattgaccgctccattgtcttattgaagggaaaggggatcagattgaccagtccgggttttcttgagcacgaactggtgaaaaaaatgacacccttccatttttctggcgatattcgcgggcatgctgaattgttggatggctctgtccagtgtttcaatatcatgacgcgtcgctcttgctgggcttccgaaatttcggtgatatcccatgagcatcttttaccgacttctcacagtggtgtgctttatgttttaaaaggccgttgggaaatgacgggctcagattgtgttcagcttgctttcgggcaaggagcctggtggctgccagatatacgggaaggttcaattaagccgctggtggcggatagccagttattgtgggttgatttacgcccgattgggtgattattgaaatacttaccggatgcggcttggtgtaatgtcaggccgctacttgaaagataaatgggtatataggctaaatccattcccggatatttttcatgcaaaataaaattccattctgtcataatacattatctatttgtattcatacgccgaatccataatcaagattgaaaattttatttcaatcttgattatggattatcattatgggttcattccatcgaaaggtaaaataaagaaaggttcacatttttttgattcgcatcctaagaagataattttgtttttattttcgaacgtaatcatcccgccaccattgatataaaaattccatacttcattacttatttgtgcttttccatttatattacatggagtttgatagaaaatactatacgcaattaacttgaagaggcgggttttaaaatctggaagttatcagtcaaccgagtggtgagctctttcgctttttctggcaatgtgacatgaaaaaagtgacgcagcgtttcacggaatgttttggtatccggaaaatagacattgtttcgtacctgctcattcacatacttccataatcgctcaatcgggttgaggttagggctgtaaggcggcaggtagtgcaactcaatattcaaaacctcggcaaaaaattgaacgactgcggaacggtgataacccgcaccatccagaataatgtggattttttgcgaaagtgggtaggtttcccggattgagccgaaaaaaaggacgacatttttcgcgttaatcgtcggatattcacgaacaatagtctcttcaatccgttgtaaattaagggcacccatgatgttgagtcgagtacgactgcccgtggtttcaaccactttgacgtgcttccgcccgctcttcatccagccataacttaattttgtggacagggtcgggtgaaccgcatcaataaacaaaataggcgtattctggccacattcttctttcaacgcgttgtaggtttcaataaactgttgctgtttatccgcatcaaatttatgcggagcacccattggcttcttgtagctgaaaccctgacggtgaagccatttcgtcattcctgcaacagtgaaagtcacctgccatcgagcccgaacataggccacaatttgggcggtagtgtgcatcaaatttgccatcagatactccactaatgctgtcgtttgttcggcagacaaacggctttcagagcccccattttcaggggcgagtttttcctcagagaagtaatctttcagatggcgactcaccgtactttcatggatccgcaaagcctgggcaatcatctgggcagtccagccttctgaggccaaaagcacggccttaatgcggtcacgtactcgtccatcgcgagtcgtatcatgcatcaattcgagggcttctttttgggcatctgtcagattaattttcatgagcgcgatcatgatctgatacaaatgaaaaatcaagcatcttcaatgacgacggatatatatggataatctttatattccttgctgatcttaaatattttatctacattttctttacttaagttccattttttacattcattaataatgtctttatcattgctttcagttaattctaggcctgttaaatcaattatttctgttttattttttgaataaacgtaagggctaaatattattagaacaaagattagcactttcgccttctgttttataagatattttatcatgttcatatatatcactattacctaaattgtaattacattttagtaagttaactaattttttaattgattcttttgttaaaattaatattatcattaagtgctattaacaatgttttttccttttcgttgataggttccattttatattcattttgacgataaattaattgcttttgataaagcagagttaagaaatgtgagtgagctattgttcataaactgcaaattctcttcgtatcgatcgaggtatgtacatatacgttttctcaaatatcctcaaccaatattgacgctaccgccgccaataacaacactaccacagttaactgcgtcgccagttctggcggcaggcttttcttcgataaaaactgaacctgagccgcctgctatcgcccgtgaatgagacgagtgtgattgcagagcatctccctgccgggcaagataggcaccatcaaccttgacactgctggcgccggtaatgactggcgtcgccgggcaatcaccgtgctctgtgccgatatcaccgattttgactgcattttccatactatttttctccgttgtggttagaaaaggggaaacctatttatcattcttaaatatcttcaataaagttattggctctataccagccgggagttccatcatcaacaagattggataagagtgatttgtcaaaatgatcaatatcaatatcaatatcaaaatcatcttctctgatcactttcttaagaattccttccatagaacgggtatctgtgattttttcggcaagcagataatcatagaaaaaagctaaaaatgatattgaattgacgatactgatgctttttctcagttctgccaactcagatagcagaaataaatcaagtttttgtaagtacttctctttttgctttatttctatcaattcatactgctcttcactgattttgaaaatcttatatcttcctttggcgttatcaggatatttttctcggacttttagaaaattatcctgtttgtattcacctttataatctgtggtgattttatgaataggccccaataagcaatgcatttcccaatcacttaagacttcgaggaaatcccagatattgcgcgggtcgtaaaaacggaaaaagaccggtttttcttgcccgggaagtagcacttgcaggtatttccgtaaatggtggcgcagagttttcaaatctgctgtgctgtgcagataaattccccacggcgttttgcggcattccagccagattttcacctcttcattgacctgcactaaataaggcgcaatttcagccagctctggctgtaacggttcactgtaaagacaggtggaaggcggatcgtagcgttccagcatcaaagacaaattcggttctgccgtcccatcaacaatggcgtaaagtatctcctgactcattcctgcttctccttcatcgggcaatgggcgacaaacattgaaccttcgccggcggcggccagcagaatggcggggttggcgggggccagtaaatcgccgggactgccgccggagttcagataccgtctcagtcattaaactgcaagcggtatttctgcgttaaataatgtgcctgatttcatcacgccataggctaatcgtaagagtttacgcatcactgcacaaacaccgactttcccccctttatggcgtgctgtcagctgttcccactgctttttcactactttattgcaactgatcgctgccagcccaggcatataaagtgcttttcgcagctcggcacttccctgcttcgagagatgagcccgcccttttagttgtcctgattcatgtaatttaggattaagcccagcgtaagccaccacttgcccactatgatgaaaccgtgaaccatcaccaatataagccagcagtgttgcgctcaaccgttcgccaataccgggaatactttccagtaaccctttatttttcttcagcgaaggcgagtcatcaatgtgcttttttagtttcaattcggtgtctttgagttcttgctttagcagggtgattatctttgcatgagaatcacaaacaacttcatccgccacggagaggcgattctcttccgtcaaaagcatttcattcagcttattgcgatggcggactaaagccagtaattggcgttcacaaagcggagcgggctgccatgccggaggatgctgactggcgcaataacgtgctatcagtttggcgtcaattttatcggttttattgcggagtaattccgctttaccaaaggcatggatttgtaccggattgacaacactgataagaagccccttatccgaaagataaagtgcgagcggatccccataaattcctgttgcttccatgcaaaaatggtaatttgaggcgggtttaagccaattaatgaaggcgtcgaatcccttaaggtcatttggaaaatgcttcattttgtaatgattttcgcctgcccaaacggcgacatcaaatttgtgtttggcgatatcaataccgactacgatgttatcagacataaggttatcctctttgtcagagacacaggagatatcgccatgattagacttataaaatagatgctcgaggcacaagataccgttcaatcttaaaggtgataaagaagaggctgttgtggtttactctgaattacgaactccattgaatgacacatttcaggttcaggttaataataacaaactcacaacagcatccctgatgatcagtcaggggattatcgctctgtaaaagtgataatcaagatataaggttgatagcggtacctttgatatcaattccgcccgcatggagcacaataaaactgccgccgacactcagggtgactttactgccgctttgcagggtgatatccccttgtatatctacacttaacacaccctgaattttttcaattaagtcgcctttgacttgtaatgagcgatcaccgtcagtttgctcaatatagtttcctgtggttttatggtcttgctggccttctaccgtgactttgcggttattggcaatgaccagttcatcgtcatgcccaatgctggttgtgcggtcatagttaattcgttctccgcgtgaattgagcaccttaatggccaggtttttctgggcatgaataaatatctcttcgcgatctttctcatcttcaaaacgcagttcgttaaacccttcgcctttatgcgttttcgagcggatcgacatctgggtttttgccatcggcaggcggtttggcggaatattgttggcgtgataggcccgcccgacaataatcggttggtcgggatcaccgtggacaaaatcgaccagcacttcgtgaccaatgcggggaatggcgatcatccccatcaattgccctgcccacgcttggctgacacgcacccagcaggaactgcgatcattgaattcaccgtacctgtcccagtcaaactgaatacggacgcgcccatgttcatcacaaaagatttcttctccctctgcttctccctctggcccaacgacagtggcgatatgcgggccttccattttgggtttcggataggaggaagggcgataagaatttttccggcgggtgaaggtaaattgattggacagccatgtaccactccctccggaatgggtttcgtctgcctgtagctgttgtccggaatgagtgatttggataagctgccattggtcattgaacgcgtctctgggatgatcggtcaagctaaacaactgccccggccacagagcaaaacagtcaccctgaccgttgccaagctgagtatccctgcgcaggtattccagacggtactggcttgcccgttgtcccagcgcatcgtccttataacggctgggaaaatcgtaatagtgataactgttcagtagccgctgatgctcaagattacggccttcataccaaaactcccggttccagcgcgggtttttgaatgtccggtctttggtagtgatattggcaacaccgacttgttctgaccagctaaattgacggatacaggttgtttcacctgttgcatcagtttccggacggtaagggacagtaatgacctgattgagggaaaggcaggagtcgtgaaacacaatacgttgttcgtgctgttcttgatcgaaagtgaagtagtaaaaaataccttcatcggccagtaagcgttggataaaggtgaggtcgctttcatcgtactgaacacagaattcccgtggtggatgtttgtaaccgagggcaaagaagaaactgcttacaccgttttcccgcagtagaatttcaacgatatccatcacggattggttctggaaaatccggctattgacccgcaatgatgcccgccatagcggtggttgaatggtgatatggtaatggctgcgatgacgtccggtggacagcagtgaaaaatgtgtcactatgccggtaatctgtcgttcagcctgcccattacggtaaacggcaaaagcggcatttctgtcgaggacatcggcaaagttaatctccgaggttttacaggtcaatgtggcttccaaccgaaaaggggttgatagcgcttcattcagagaaaaatcgacaacggcaaaagtttgttccggtaaattttccgtgatcagtgtaaatatcaggcctgaacgatcaagtagttgattgattttatccattaccctgctcacttgttctctccgtaatctatgggtatattagatatttctatttttagctgattttaatatctgtttcattattgtctgtttgagtaagaagcttttgttctggagttttttcaggacgttcattgtaatgatctttatttaaatcacttttggggaatggggctggaattgtttttatatgaggaatgttattatccacttttatatccgtcattccgcacctcattcctgatttaaaaatcatgtgatttgccgcacgctttgttgatttactcctcaaatcagattgacggcaatcttcggttttgatctattacttctatttaccggaagcccaacatgtctctctctgaacctgccatcaaacgtctcgatcacctcggccttgtcgccgctttttgccatgagatcggtttaccccgcatgattgatgctattttgcctaaatatgcagagcatacggtttctcatggcgaggctcttttagcgatgatcctcaatgggttgggtttccacagtcgaacgctccatatgtgccctgatttttttaagcacaaacccgttgaacgcctgattggggtgggaattatggctgaacacctcaatgatgatgtgctcggccgcacgctggacgccttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgaaaaactcagcaaaaagtcgtttccctgtggtgaagatgctttgcaggcattgtgtgacttcgaagcagaatgccagtttatcggcattgaggcccccaaagttcaaaaaatcgaggtgcataaggggcgaggccgcccggctaaaggtcaacatcccgatagtgttcattatcagctttctgcctcggtctacagccaactggggaaagtggcttatgcccgcctcaaagtcggcatgttcattctggcgacgaatgaaatggacgataaggcgctgaatatggaaactctgctggctaattacaaagcgcaacaaaaagtcgagcggggtttccgtttcctgaaaagtccggagtttctgacttcagcgatttatttgaaaaagccagaacgcatcgaagcgttattaatgataatgacatgcagtttaatggtttatgctgcactggagcataaaatccgcaccggactgaagcaaaatgccccgttctatcccgatatgaaaggtaaacccacccaatctcccacggcgcgttgggtgtttttgaccttcgaagggattagtactttcgagtttcaggaacaccgtatggtgacgggaatacaggtgtatcaaaatgaactgctgaaaatattggggcaaccctatgaatcattttattcctgaaagtggtgcggaatgtcggttatatctccgtcgaatgttcccagagctttattaattctattaatgttactaaaatcattccacgtcattccgggttttaatccagcacttcgcagtgctttccaggtaaaatcaatgcagctattccaggctccgttgtaataaaggttaaaatcaggatttgaatttttaactgcagaagttccataatttctcaattggttatattgttcctctgtgatttctaatgttcgtttatatcgtggcttttcataatggatggtatctttttctgttactattccatctccatgcattcccgattcaatgggagcaaaaccataggcgttatcagattttccatctgagatttcataccacatatgtcccgcaaatgatgtcacacgttctccattcttaaatttgggttctccattatcctcattaagaggagttccgggatgagcagcatagatggtgatggtatatcttatacctaaagatcttattaggttttccacaaattcaggtcttgcctgtggaggcgggcatgtcgtacatggctttcctgccgcataattcacttcttggtttgggtaagcagttgagttgataagatttgttttgttttcttttgaaaaattagagtcattagtaatatttagcaataattcttccgttgagtttattggtgtcatctttattttcctgagaaagaaggaataaatagataataactgacgttatcattttttaattcaggccaattacctaatatttctagatttaaacgatattgaccatatttatatctttccccaaggctaacgaatctaaataaaatcccatcagcagtacctgcaattgagtcaggctccgagtatgtttttttaaacactaatgtttcagtgaggtcctcattaattttatgtaattttatagataatataggagcatcttttggtttagctaatggaccatcattcttgaataagtcaggagtataatcagggcgggattccactttaagatcgattcttttatagccaaaaaacgtatctctacgtaaaattttcaccattttatccaagaaatcacatcatattttacgtacaagctcctaaagattaatttttaagcaaagtaaaatcccgccctgggagtataataggttagctcatcttctttatacccttttgtttttaacataactcgaggttcaggagtatgaccaggaaaaagatataaaattttaggtgggggttgaggaacattccaaaatactaattctattttttccccttttttatacagtttaatggggacttcaatgggatgtcctgtagttggttttggagttaaaaaaaagtaagggtcctctgttggaggacgcatccattgaaccagtaatacgatacccgccccgagaaaagcagcaaaaaccaatagcataatttttttcaccatatctgttatatcccatcagaagcaaagaaaattcagggttatgtttcacaattaaattaatcgctaccatgtcatcacatcatcctgatccctgaacgaattgagtatttggttgcgtgcatgggatcatccctatagatcccacccaacggaaattaaaccttgcttcttaccctttaacgataaataaattatgtgtgacataagccacatcatcctagtactacagccgtaatccatcatgtgccatgatagggctcttcttccttaaataaaaggcggtgtcacatgctatcccctgccaaaatctgggaacaggcgctacaggcattacatacccgtctggctcccttatttcactctaccggctcacgacaacgcagcctcgcctatcttcggggattgctcagtgatgttgaacgtaagaatagctggcaactggctgaatggatgggggaaagtacccccgatgggattcaatatttgctggaacgcgctgattgggatgtcgatatggcccgcgatatcctgcgggattatgtcactgaacatttgggcgatgaacagggtgttctcatcattgataaaaccggttttatcaaaaaagggacacattctgccggggtacagcgtcagtaatagtgggaccgctggacgggtagaaaacagccagataggcgtatttctttgttacgccggcaacggagggcatgcctttgttgaccgggcattatacctgcctcgccagtggacagatgcccgttcccgctgtgaagccgcgggtatccccgccagcgtcacttttgcaacgaaacccccgttagcccggcagatgctggaacgaacatgggatgccggcgttccctgtcgctgggtgactgcggatgaagtttatggccgtgaccgtcgtctaagagtctggctggagtcccgatacccgccctttgtgttagccattccctgcaatacccccttagggtggcgagggccagagtatatccgtgctgaccggattgccgataccctgaccgccgctgactggaaaacacggtcagcgggaacggggacaaaaggtgagcgtgagtatgactgggctgtcgtgccgttatggcgtttacagctcagtgaagaggatcgacattatggtcattatttgttagttcgacgcagccgggatagcagacaggaacgggcttactatgtggtgtatgccctgagagaacaggtggatcttaatacgctggttcaggttgcgggttgtcgctgggaaatcgaaagtggctttgaggaaaccaaaggggaatgtgggctggatcactacgaagtgcggcgatggcagagctggcaccggcatattaccttgtcgttactggcccatgcagtcctggcggttttgcgggtacaggagaaaaaaaacaccggtaggccgggttccgctcagtgtagcggaactccgtaagctgctgtcaaagctgatggaaaaagcgggaaagacaatcgaacagattttacattggtcagactggcgacgacggcatcaataccgggcacaacaatgtcactgtcgccgccggggaaatcatcggcttacagagcaattacggctgtagtactaagatttaaatcgttccgccggtcacaaacgtgactggtgggggatcgaactcgttgctatgcttcgaaaaggccagtatcggcaagaagagggtgaacgattatccgcggctgaacaattttatcgtttggcagtataaaaaacaaacatacctcattatcgctcaagctgattcatttaatgcgacagaacccgtaatctttatcgcatcccacagcgagacaggggattcactataaaagaagttattgacggttttctgaaatttcagcgtgacgcttttcctgagtgcgtcgcgctgttcagaagcctggccacacagcaaagtccgcggacgttggttatctcctgctcagacagtcgtatgatcccggaactgctgacataactcgctcaaaagtccgttgcatacgagcagttcaacccagtgaagttgtgcaatcgttttctgaaaatgacaagggtagaacaggtattatctgcattacgtggttgcctgatattatgggtgatttattgcctgttattagtgtaaataacaggcaataaaaagtgtgatgggggtttactttcccccctttagaaagaaacgtcgagcttttgtgacaggctcggtagggcgaggtgatttgttttattgcatgccgtttgcagatttattttgcgatttagtcagcatatataagcggaataggtaaatcagcagtatggaagatagcaggttatttagtattgacagtacgatatcgggcattctagcgaaaccaagagcgataattagctttattgcaaaccataacagtatggccggggctaacagacgcagattggcaaacgccaatttccagctttcctgcatggatgagaaaacacctcttcctttttcaagcagaaaaacaggggcaaatgcaaatgcaatagaaagtagtatgccgggaatgaacatcaacgcgtaacctaattgaatcaacagggtacagataaacatcagcaaaaacattttaggcagcgatcctattgatgatttgctggcatggagcgcattggtttggtgcccgttagaaatggcattgataagtaacaacacattggcggtcagcaatgtactgccgaatatgttggaaaatagaataccgaatgctgtgcgtaagaacattaactgttcttctggcgttaattgcgccacaaaatttttgactcctgtattgcctgactctttaaaggcgttttgtatctcaaccagcagtttgagttgttcaccatcaggcatcagaagatgttcaagcagtgctgccaccaacgcggccaagacagagagtatgaaaatatttaacagctggttcttaaaaaaattgaagctgtcacgatacaggatatttgccgtgatgggcatgaaagtggctcctaccagataaaacaacaatgatactcaattgtaccttgtccgggggattattggatacctaaaagattaaagcaggtaacggttgaggaacattaacagatagaagagagcaggggaggtgatggatgattttcaatcaaatgatagatctattaatgttatgttaattaattggaatagaagtgatattttttatcaacctaatgcttgtactcttaattattattgttggtcaaaaaatcatataaagatataacgccgaatagtcataagattaatatccaattaattttgatttagatcaatttgaaatatttggtagatgaaataataaattcatcaatactttattttgacaaaaatatttaaaggatgtgatctgtcttggatcataaaggtaaacaaacaggtatatttttggctgatttaaaaccacataaatgggatggataatgaaaaaaattttttcgcttgtattggctacggctgcgttagctccgtcattgacctttgctcatgaagcaggtgacttcctgttccgcgcaggtacagcaacagtaagaccgaatgctggatctgataatgtgttaggtcagggatctttcggtgtaaataataatacgcagctgggtttgacttttggttatatgatcaccgataacattggtgttgaattattagccgctacacctttccagcatcgtgtcaatttaccgaaagctggtgatgtggctaaagttaggcatttacccccaaccctaatggcgcaatattattttggctccaaagaaaataacttacgtccttatgtggggattggtgtaaattacaccacattctttagcgaaaaatttaatgacaataatgcaactgttgaagccgcgaaattaaatagtctggatctgaaagattcctggggtgttgctggtcaggttggtttagattatcagttggataaaaactgggtactgaatacctcattgtggtggatgaatatcgaaactgatgtgagatttaaagcgggtgatgcagaacaaaaatataaaactcgccttgatccatgggtgtttatgtttggtgtcggttataaattctaacagtttgatatataatactttgttagatggtaatagagtaagtaagttccgtacgtgtttgatataagagagaaccaatggggcctaatctggggttgtacgccggaatcccagatttttccgtcactttagcttaaggtgttatttcgccccctaccggaaccgacctcttcaaggggaaagtctgcttgcttcgattggcgttctggcgatatcgccattgcggatcgaggatacgacaaggctatctcacttgattgtctcgctatggaaggttttccaatagaaaacggatctgattctcacccatcagtttagcaatcctctctggctgcgcgccatttttcagtaaagcgtcagtgacactaacgaggccagtagcgtcgaagggcatctcaaccgcaccatcaaagtcagatccaagggctacatgatcatcgccggcgatattagccgcatagatttgtgccttagcgataccggtgggggtaggatcgcacactgctttgtcccaaaaaccgataccgatcaatccaccctttgcagcgatccgcctgagttggtcatcggacagattacgaatgttgtcacaagtacctttgacgccagtatgggaaacgaccacgggtcgcgtcgcgattgccagtatgtcatcaatggttttggtcgaggcgtgggccagatcaatgatcatactccttgcctccattcgccgcaccatatcggcaccggcagcagttagtccacctttttcaataccatgggcagatccgcccaactctgtatcgaagaaatgagtaggtgccatcatccggtagccggcctcgaaaagtacatccacgttggctgggtcgccctcgagaacctgtgcgccttctgaagcgagcagcgcacccacgatctttggatcactcctgcgtctttcaaggaaggccttcaagtcagcgcggcttttgatcaccaccagtttcccatttgaacgagcggcagcctcatgtaggcgcgcagcttgatagagtgcccgttcttttaaactgaacagagttcgccaaggccaacgttgtgccagggcaagcaaagtcacattgtcagtttcggcgctattcttctcgatattcagcccacgtggtgacttagaaacaacagcaaagatctgcacagccacattgccgtctattaaacgcggtatgtcgacttgcccacgcgtcgatcgatccaaaagatccctgccccagagcagcgtatcggcatgcaagtcggcgatctgcagacgcttgtgcaagtcaactgcggtttgtgtcgctacatcagtaaccccgatcacacgattcatccgtgtctcaatgagccttggcaggacgaaaaagaaaatcatggcacaagcacaaataactccccctactcccgctcccgtcagaatgatttttgcacgtcgtgtcatatcccacctctcgacctattgagccaacaacagttgccgcctgaaccgcaccgagtttacgctacgacatgcacacatcgcaagagcctgagtagatgtgcgcgcatgtcgtagcgtaaacccgaggcgctgagcaacatgcgctcacttgttcacgacgataaccccaatctgccccatttttacgtctgtggatataggttctaacggattatcgaagcttgattgaattaatcacggtattgacacccttaattcctttagtgatttgtattgcacgtgtgacgtcttcaggagagctaacgaatccacttaactgcacacggcctttgaaagtttctacactgatttctctggattttagatttttggcctcaagtaatgctgattttactttggctgtaatgacggtatcgtcaatgtaattccctgtactttctgttgttgctgttggggcacatgcagagatcgtcatcgccataacagtagcaacaaaaaacgtagagactacttttaatagtttcataattatgctccgttgatctcaagaacaatgcttatttatcgaaacattattcttgtttctactttaggtatcatgccattgtgtaatggccgtaatcagaaagtattattgaaaacgggaaaacctacaaatgataggggaaatatttattcccggatggtgataggttggcggtaatagctttccccatcaatagatgatgggggaagggggaagattaacgttgtgtcgcggttttcatggttcggacaaacgtcactagtttttccagtataatttggggctggtttaaattatcttcaatgatttttaccacggcggagccggaaatagcgccagccgcgccgctatcgagtactgatgtgacttgtgcgggctccgatatgccaaaaccttgtagtgcaggagcggcatgatactctttgagcttattaactaggtgcgttagtggatgttcagctcgattctgagttccagtgaccccggctcttgacagcagataagtgtaacctcgcccacatactgctatttcacgcagtagatcatcatctgcatttggtgggcaaattaatatcggagcaatgtcatatttcaatgcagttgagcggaaatcatgcgattctgataacggtacgtcagcgatcaaaacagaatcaacaccggcatttttacagcggcgataaaattcgtcgatcccattgtgaaaaaccagatttgcatacatcagcaatccaatcgggatatcagggtatttagctcggatttgagacagcagctcaaaacacaatgcaggtgtaacattggaagataatgcccgtaaattcgcgttttggatggtagggccatcagcgagaggatcggaaaatggaatgcctaattccagcgcatccgctccgccagcgataagtgcgtcaataatctccagagataactcaggattaggatcgcccaaggtgacaaaaggaacaaaaacgccctgattttggctttctagttttttaaatagctgctcataacgttccatcagatttcccccttggattgtaaaatatcgtgtacggtaaagatgtctttgtcgccacggccagataaattaacaatcaataattgttctttatcaggagcctgatggatcattttcaaggcgtgggcaagtgcatgtgaggattctaacgcgggaatgatgccttcgttgcgcgacagagccttgaatgcgtcaattgcctcatcgtcagtgactgaaacataatcagcgcgtccaatattgtttaggtaagcgtgttgggggccgacagaaggaaaatccagtccggcggaaatagagtaagattcttcaatttgcccgtcttctgtctgcatgatcggagatttcataccgaagtagatccctagcttgccatgtttcaatggcgcaccatgttctccggtttcgataccatgtcctgccggttcgacaccaatcaggcgaacattggtttctggaatgaattcagcgaacaggccaatggcattcgagccgccgccaatacaggcgataaccgcatcgggtaaacgcccctctttttccataatctgtgccttggcttcctcgccgatcattcgttgaaattcacgcactatcgttggataaggatgggggccggcggcggttcccagcaaataatgggctttgtcatagcaaccagaccagtcacgcatcgcctcgttgcaggcgtctttcagggttgcggcgccactgtgaacaggaatgacttcagcgcccattagacgcatacgaaagacattgggggattggcgttcaatgtctttggctcccatgtaaatacggcattttagccccagaagtgcacaggctagtgcggttgccacaccatgctgaccggctccagtctcggcaatgatttcgtttttacccattcgctttgccagcaatgcctgccctaatacctgattggtcttgtgcgcgccaccgtggagcaaatcttcccgtttcaaatacagacgactttttgtgcctttggtcaggttctggcataacgttaaggcggtagggcggcctgcgtagtttnttagtagatcctgaaaggcttgttgaaattcaggatcgttctgtgcctcaataaatacttcttctaactgatcaagggcggggatcaagatttggggaacaaactgcccaccaaagtcaccaaaataaggattcagtttactcattattcgcatcatccgttttctgtttgtaaggttagtgataacagcgtaattgttggaatattagtttgattttttgactgcttttgatgccaacgcttgtttcgacaccagaattaaaatctagtccataacatcccagcgcggctgcctgttggcagttttcagcatttaacccaccggccagcatactgttacgctgaaaacgctgatcgattaattgccagtcaaaggtttctcctgttccccccgctccattatccagcaataagtggtcgatattggatatttcggaaaattctgtagcctttgacatatcaatggctttccaaatctcacaagattcaggtagtaaaggacgaagtgcattgatgtagtttttgtcctcattgccatgcaactgaacggcattcaaggaaagttgccgggcgatatcactgacaaaatctaatgattggttttgaaatacgccaacatattgcagaggagcttcattgatgatctgctgggcgtgttgcagattaattttacgcggtgatttttccgcgaaaattaagccaccataaacagccccggcttgtaacgcagttttggcatcttgtgggcgggtaagaccacagattttattgtcacccagaatcaaccgacgtaaggcgagatctaaatccggctgtgccattaaagcactgcctatcaggaaaccgtgggcaaattggcttaattcacgtacctgttgatgctggttgatgccagattcgctgatgataatggtgccttctggtaaatcagttgccagcctgcgagtgcgatctaaatctatggacagatcacgcagatctcgattgttaatgccgatgacttttgctcctagcacaattgcccggcgacgttcatcttcggtgctgacttccgtcaatacgcccatatcaaggctgtgtgccagtgcggacagctcacgataagtctcatcattaatcaccgaaagcattaacaaaatggcatcggcctgataataacgagccagataaacctgataggcatcaatgatgaaatctttacacaaaactggctggtgtaccgcagagctaaccatgcggagaaaatcatagttgccctggaaatatttttcatctgtcagcacagagattgcggcagcgtaaggttggtaagttttagcaatgcgaaccggatcgaaatctgtacgaattaacccttttgaaggggacgcttttttacattccagaataaaaactgtttgcttatggctcagtgcctgataaaactgacgatggctcggtacaatggaatcaataacactttccaatggctgctctgctttgcgttcgaccagatatgccaccttatcatcaacaatcttctgtaatatgttgtttttcattgttaaatccttgccgctaatgcggtcactttttcgtaggcttgaccgctataaatcgtgttcaatgccagttgagtattttcccgtagattttcttgtccgtggattttcatcaaaagagccacattggcggccacggcatcaacatgcgctttttgtccacgaccttgtaataacaggctcaacatatcgcaattttcttccggtgttccccctttcagtgaagatattggatggttaggcaatccaaaatcttttgctgttaattgatactgaattatttccccgtgatttaattctgcaacgagagtgggggcatgtaaggcaacttcatccattcctccactatgtacaactgcggcacgctgatagcccaaaacctttaatgtatgggcgatgggaaccaccagttcggggctgtaaacgccaatcagtgtccgcggggggcgtgccgggttgatcaatgggccgagtacattaaataatgtgcgaactttcaactgttggcgaacctgtacgacgtggcggaatccactatgatattgtggagcgaacagaaaacaaacaccgatctcatccagcgcactgcgtgaatcctcggcactggcatctaatgcgatgccaaacgcggtcagtaaatcggatgatcccgaacggctggaggtgctgcgatttccatgttttgccactttaaggccacaggctgccgcgacaaaggcgctggttgtggaaatattgatgctgtttgtcccatctccgcctgtacctacgatatcgcagaaggtgtaatcaggacgtggaaagggtgaggcattcgccaataatgcctgcgccgcacccgcaatttcctgtggctgctcgccgtgcagtttcatgctgaccagtacagccgccaattgagcgtcactcagttcaccacaaacaatcgcggtaaataattgctgactttcttgttgtgtcagtgtttgggcactgaacaatttttcgaaaattaactgcattttcctattccttattattcctgtacccatgccagagtttgttcgagtaatttagctccctgtgtggtcaggatggattcaggatggaactggaacccacagactttgtgtctgtcatgacgtaccgccatcactgtatcaccacaagaagccgaaaccaccagcgtgtcgggaatattcatccccgtaagggaatgataacgggcaacgggcagagggttgattaagccggaaaacatggcctgcccatcatgagtggccagagtggcctttccgtgcagaatttctctggcggcagagattgttccaccataagcttcaataatcgcttggtgtccaagacatatcccaatcacaggaatttggctaatgatacgtttgagcaactggggcatacagccagcatctgccggctttcccgggccgggtgataacatcagaagcggtgattccatctgactaagttgtgtcatgattgtttctgttgataccgtattacggtagataacgacctgatgatcactggcacgcagttgatccacgaggttgtaggtaaacgaatcaacgttatcgagcagaagaatatttgccatcagaatgtcacctccgccttgtgtgcctgagcaatcgcccgaataacggctctggctttactgtgcgtttcatcgacttctgactcgggaatggaatctaaaacaatgccagcacctacttgaacggcggccgtgccgtcttccacataggcagagcgaatcacaatgcacatatcaaaatcccccttggcagtgaaataaccgatggcacccccataactgccacgtcgttcaccttcatgttgtgcaatgagttgcatcgcccgaacttttggggctcctgtcaatgtacccatattcatgcacgcttgataagcatgaaagacatccagatcgtggcggagtgtgcctacgacacgagaaacgagatgcatgacaaacgaatagcgatcaactttggttaaatctgccacatagcggctacccggttcacaaatgcgtgctaaatcgttgcgcgccaaatcaaccagcatcaggtgttcagaaagctctttggcatctgtacgcatttccagttcaatccggccatctagatcggcattcagtgtgccgttggcattgcgtccacgaggacgtgttccggctattgggtagatttcgatctgacgactgctggcatcatatttaagggcactttctggagaagcaccaaacagacaaaagtcctgatcctgcatgaagaacatataaggactggggttttgatgtttcagcgtttggtaagcattgagtggagaaggacagggtaaggtgaaacgccgtgacggaactgcctgaaaaatgtcgccttgacggatggattgctgtaattgctgcacgatgtctgcatattggtcatcactttgattacaggcaatggtcatgtctggtaatttcacagattcaagtggttggccgggtttcgaaatggcagcagttaatgcggtcaggcggtcatgaagacgctgtttttctgaatctgattcaccaaacagtgatgtttgcaagaatgcgtgtttatttcgatggtcgatcactaatagcgtttctgcgagataaaaacagaaatcggggcaacgttgatgagttttgaccttgggaagcggttcaaatcctgcaactaaatcgtaagcaaacagtccgcccacgaaaaattgcgtctggagttccagaaaagggggataatgtcattagtgtccgcaatgcatcgaaaatagaatcggcctttaaacggctgtcttcatccagattgtgcccagttgcgggaaactgtgcctggagaatatgtaatccaacatgcaatcgggcttttgctgagagtaaatcggtgagtataggcagtagctgccggccattttcggtgagggcctcaaaagtgacttgtcgttcgttggctgtaattctcatggcactgtcgatgattaacaggcttttcaaattccttttgctgtttatttcagccgattccagtaataacgtggctgggcgattaccacaaagctgattgaaaagtagagttggatctgtttggtaaacagtgtctacttgattgattgaaatcttaaaatttttattcatcatatttgccccgttgctacctttagccacaaattttggttataaaaaaacccgcttttggggcgggttgcggcactttcgtatctgtacttatgtgcgtgattcaaccgccctgaacgggaagttgcgccaccagcgaattgcctgcataaatacgatcattttctctgtgccttagtttgttaagtggaataaggataaatagtaaagcatcctgctgatctttgtactagttaactggatcaaagcttgcttgtcaatgattttttgatgtctttagagatatgataaggggagggtgtaaattgaaaaaacggtgacttgaaatttattgggtaatatttctattgttattaatatagataaacttaatttaaaataatgataataaattaatgtttttataaatatttaagattttttcacattataaatatattggattttttttgttttttattagatgcattgagaaattacatcaattggtattatttattttataataacaattcaattgcaaatatattttaatagccttgttgttatttaaaaatgttattttgatcttaatcataatatcagtttttaattgatgtctatgtttatgaaatcaagtaaaattattttatattttatattttatattttatattttatattttatattttatattttatattttatattttatattttatattgtttttcattgccttgattgtttttaataatgctggtgcaattgaattaatgagtgattatattgttttaagaggaaattatgatgaattaggaaaaaataaaaacagaagtaatctattagcagattataatatgatttttaaaaatgacagtaagcatgataattttgaaattaaaatgttaggttatcaatgtgtgtataaagttggagatgaatatataaatttgaaacctgggggataagcataatgagagtcttgaggatagtaattatttttttcagggatgctcaggtgcaaataagttcgtaaaattggaagtaagtacttataagaagggtaaaaaatataaatcatgtgtttttagaatggaaacgtatttaccatcgtttccaggggcgtatcttgtgtggcagagcatagttgaaactgatgattgccatcttgaaatgattgctacatgtaacggagtaaattgtttaaataaaaatataaattttatttaaacaatgttgaggaaggtagggaacgttcctataaaataggtgcaatgcaaaatattgaggatgctgatccttatttcttgacgaatttaattattttggctcgggctattttagctctgaatttattgataggcatagaattagcaatccaaaagagattatacccactgaacttaaaggtcaaaaattatctggtattggaggtgatgatagccgttctactttgtagaatggtgatatatttttatcttcataatattctataaacatagagggagagaatgaaaattattattccgaagccagattagacaaagaacaaaattctggggttattccaataaaatatggtgattataaaaataaaaagaaatttcctatttgggatatcactcttccttctatattgaaatacagcctctatcgcattgaagtagtagacaaatatcattcattgggattggctgatatcaaaaaaaattggcagggatcgtctcctgataaaagctactttagtataaaaacttctaatgtcgagattaaaaatctttctgaaggagggacagaaattgtcggtaccccaagttttttgtcagggcgatctaatgtgccgggagatgaggtcaatattaaaagacgcaggatcgagcgctcatcagaattgaaggaaaatattcaaaaccttgcacaagaaacagttatttgctcgggagctgtggtcagtgacaatggtaactggcagtgtgacagaccaataatttttcctgtgggtacttatgaactgaccgctgaattgataaaagaaggaaagtggacgtgccccgataaccctgccttgaccgtagctaataaagggacgtttttcctttatgcggctcaatatcaaaaaacaggctcggctcaattgggtgaattgggcgatacgtatgaaagaacctcacaggtcacgcgtaagtatgaagttaccgaaacaaaaataaacatcattgcccccaatcatggagcaaaaataataaaactaccttttactatttcaggtacgggagaaaagggatctcaggtatatatcgaaggttttggtggcgccgatgattgtaatactactgttgatacctcattaggccaatggtcatgtgggccttatcggccggaagatggcaaatataccctctccgcagatcaatttatcgataatcagttagattcaactgcgcaagcgtcttttgaagtccagacgaaaaccgtcaggccagtagttatcacgtaaccgcataacgacgggatatatcggcactttgacagcatcaaattgtgtagaaccagtaaattcgcaccttcaactactccctctgtgttatcatccccgcttcatacttgatatcacttgatagatagcacccttgcttctcacacgacaaaaacaggtacagtacaatgactgaagccgccagtgaactgataagacgctatgacctgcatagccatacgaccgcttcagatggagttttatcaccggaacagcttgtggatagggcggtttctatgggtatcaacgtactggcaatcaccgatcatgatactacagatggtattcctcctgccttaaaccatattcagcaaaataatttgcctttgacgttggtatccggcgttgaaatttcgacattatgggagaattttgaaatccatattgtcgccctgaatatcgatactgattgcgtttttttgacaaactttctctccaatcaggtaacgttgaggaaacagcgtggtattgaaattggacagcgccttgctaaggcgggtatccctaatgcctgggaaggcgcctctcgcttggcaaatggcgggcaggtcactcgcgggcattttgcccgttatttgattgaagcgggagttgaaccgacaatcccaaaagtattcaaaaaatatctggcgaagggaaaaatcggttatgtccctgctcaatggtgtacaattgagcaggctattgaaactattcatcaagctggggggcaggctgtgattgcccatccaggcaggtatgatttatcgatgaaatggctgaagcgtttgatagcctggtttcaacagcatggcggtgatgcaatggaagttgcgcagtgccagcaggcacctaatgaaaggcaacaacttggtcaattggcaaaggaatatggacttaaagtatcattaggctcggattttcaccaaccctgttcatggatagagctagggcgcaatttgtggttacccagtgatgtaataccgatatggcatgattggtcacgctaggggctgcatagagtaaggggttatacttgtgagccagtttttttatatccatcctgacaatccacaatcccgcttaattgggcagagtgtagatgtgttaaaaaagggtggagttgtcatttatcctactgattcaggctacgctattgggtgctgccttgaaaacaaggatgccatgacacacatatgccgtattcgccaattggatggacgccacaattttaccctgatgtgccgtgatctttctgaaattgcggcttatgcgcatgtggataatcaggcattcagattgataaaaaataatacgcccggtaattacacctttattttacaggcgacgaaagacgttccccgtcgtttgatgaacgaaaagcgtaaaaccatcggcctgcgtgtcccttccaatcctattgctttggcattactggaaggaatgagagagccactgatgtcatgtagcttgattttacccggaaatgattttgcggaatctgatccagaagagattaaggatgtgctgggtaaacaggttgatttaattattcacggtggttatcttgggcagcaaccgacgacggtaattgatttgaccggagattttccggaggttctgcgcgaaggtgaaggggatgtaacaccttttctatagggtgaatgattcacgtttttattttatgacacgacgcctgtgaaggcgacaacagaggttgctcaatgagcgataaaacgcaaaaaacagaaagaacggaaaagttacaaaaaattctcgcacgtgctggtcatggttctcgccgcgaaattgagggctatatccaagaggggcggattagcatcgatggcaagaccgcaacgttgggtgatcgaatcgaagtcaaaccttccataaaaattcgccttgatgggcgtatcttaaatataaaagagccacaaaaaacgatttgtcgcgttctggcctattataagcctgaaggtgagctgtgtactcgacatgatcctgaagggcgtccaacagtgtttgatcgcctgcccaaaatgcaggatgctcgctggattgccgtagggcgtttggacatcaatacttgcggactgctgctgtttacgacggatggagaactggcaaaccgcctgatgcatccaagctgtgaagttgagcgtgaatatgctgttcgtgttttcggtgaagtagacaatgcgaaacttcgtcaattgacacaaggcgttcagttggaagacgggcctgcctccttcaaaactatctcattcaagggtggtgaaggtatcaaccagtggtataacgtgacactgacggaaggtcgtaaccgtgaagtcaggcgtttgtgggaagctgttggcgtacaagttagccgcttgatccgtgtccgttatggtgatatcgatctaccgaaaggtttaccacgtggtggatggacagaactggggctggagcagactaactatttacgtcagttggttgatttaaatgaagaaaccatgtccaaagttgcggttgaacgtgaccaacgccgtattaaggccaatcagatccgccgggcagtaaaacggcattctcaggtcggctcctcccgtccagcggggaaacgccctgcaagtagctctcgtcagaatacgggaagaaaagcggtacctaaaggccgttaatgttttagggtcgctgtttcagtgttatatcaaggctgaaacagcggctttttatctatcttactaatcaatcttaccaatcaacccctttctgagctttgattcccgcatcaaacgcatgttttactggacgcatttccgtaatggtatctgcaagttcaagtaattcacgatggcagccccgtccggtaataatgacagactgatggataggacgttgtttgagtgcggtaagtacatcggttaggtcaagatatttgtaactgaccatataggtcaactcatccagaacgacaagctgcaatgaggggtcggataacatcgtcagggcatgttgccatacagcttggcaggctgcgatgtcagtttcacggttttgcgtctcccatgtgaaccctgtcgccatgatatgaaactcaacaccctgttgtgctagcagattcctttcaccgttttcccatgttcccttgataaattgaataacgccggcacgctgaccatggccgattgcacgagtgactgtgccaaacgcagcggttgttttccctttaccatttccggtgaatactatgacgataccccgttcctgttgagcagcttcaatgcgggcatcgactttctctttcaggcgctgttgccttttcttgtactgtccgttatccgttggcattatttggcaggccccgctttacgacccggctgagcatcaaagctgatacctgaatcactcaggctgtcatcacccatcagatagagatagaccggcatgatctcggcagggatttttaatttggtcgcattttcatcaggaaatgcactcgcacgcataccggtgcgtgtacctccaggattaatgcagttaatacgcaaggcagtttcctgatactcctgcgctagaacctgcattagaccttctgttgcaaatttggaaacagcatatgcaccccaaccacttcttccttcacgccccacactggaactggtaaataccagagagccattgggggatttcaataacagggggattaacacctgagtcagcatgaaagttgcgttgacattcacttgcatgacttcatgccaaagctgaacaggctgttctatgacaggtgcgacaacacccagcagacctgcgttgtgcaataccccatccagacggggataatgctgggtgagttcatctgcaaaggcctgacattcttcggctgtcacggtcaaaagatccattgtgtaaatggtaaccggtaagccgccactgttttcgatttgttgtttgaccgcttccagttttgctgttgtgcgccccagcagaataacctgtgcgccgtggcgagcataagttagcgccgcttcacgaccaatgccgtctccggcaccggtgactaaaatgattttctgttgcagcagatcatgattgggttggtaatctaacatctgactatcttcctgtggtttttaggaacctgttttttaaagctattacttaaggcgtatggcatctgctattttaggcggacacatgaagtctgtcatcagaacaaaacttaatgcccccgtcaaatttgctcaatatagacagaaaagaacagagctctgatgagataggatgcaagtaaactgttagagcacagcctccggtttttagttagaatgaagaatattgttcatcataattgaagataaggtggatctgtggagtatttgtctctatacgggctgttcttggccaaagtggttactgtggtattagcagtcgtcgttctggcagtattttgtatcggattgggtgtacgtaaaaccatgcataaaggggagttgcgtctgaccaatctgggtgaatcatacagggaaaaacagcgccagatgcagcaggctcggatgagtgacgcagagcagaaaatttggcagaaggcgttaaaaaaacagcagaaaaatgatgccaagcagaaaaaggcagaggctaaagcgagtcagaaaggtttacagaaatcgaacctttatgttctggattttaaaggcagtatggatgcccatgaagttgattctctccgtgaagagattagcgccatactcgctgtggcagatagcaaagatgaagtgttactgcgtttagaaagccccggcggtatggtacatggttatgggcttgctgcatctcagttggctcgtttacggcagaaaggaatacgtctgacgattgccgtggataaagttgccgcaagtggtggttacatgatggcttgtgtggcagatcgcattattgctgccccttttgcgattattggttctatcggtgttgtggcccaactcccgaatatccaccgattactcaagaaaaatgatattgatgtagaattacatactgccggggaatacaagcgtactctgactgttctgggagaaaatactgagcagggacggcagaaatttcaggaagatttgaatgaaactcataaattatttaaatcatttatttatcagcatcgtccatctctggatgtggaaaaagtagccactggtgaatactggtatggtatgcaggcaaaagaaaatgggttaattgatgatgtaggtgtcagtgatgattttctgattggacagattgaacactgtgaagtcatcggagtcagttattctcgtcgtaaacgtgtgatagagcgtttcatgggtagcgcaatggagaatgttgataaattgttcatgcgctggtggcaaaggggcgaaaagccactgttctgataatttaggtatcagctataacagatataaaacaataaagggtaataaggcggaaggtgatggtttggatatcccttattacccacacaataattgatgatctatcagggattacaccatcgaatttctagtctgctaaatgatacttttcggataatatatgtgctaaatgtttaaacatattaaacacagcggtacttttcgtggtaggcagattatagctatccaaaaaatattctcccttaaaaacgagcacttcgcctttctgttctacattatctgcatacattccctgaataaaatcgtcgtgtttcctaatgattttatttgctttttccagtaactgtttacgcttaatgggtaatgtttcagtttgcatcgattatgctcctccaaaaaataagttgttgcgcatcgttttttatcaggtagagtgtgggcttttcgtcatgcagatggaagattttgtttacaactgttaaatcatacaattgcatggcatgtgctggtatataaaataccttaaatatttcaaaggtttttgcgcttgagcaaagtacaagataaaaattagttgatatcttgcaaatctatcgcaatataaaaagagaatttattttatatatcgcaacataacgccgtgatttccgccatctgaaaagaagataattaggtaaaggtaactatgggtaaagctcttgttatagtggagtccccggcaaaagccaaaacaatcaataaatatctggggaatgactacgttgtaaaatccagtgtaggtcatatccgtgatttgccgaccagtggagcagcgagtcaaaagagttcgaactcatcaaccgataagaataaaaagaaaaaggatgagaagacagcgctggttaaccgaatgggagttgatccctatcacggttgggaagcggattaccaaattttgcctggtaaggaaaaagttgtcgcagaactgaaaacgcttgctgagaaagccgatcatatctatctcgcaacggatcttgatcgcgaaggggaagccattgcatggcacctacgagaggttattggtggaggagaggctcgtttcagtcgggttgtattcaatgagatcaccaaaaatgccatcactcaggcttttgacaatcctggtgaactgaatatcgaccgtgtaaatgcacagcaggcgcgccgttttatggatcgcgtcgtgggttatatggtttcaccgctgttgtggaagaaagtcgccagagggctgtctgccgggcgcgttcaatccgtagcggttcgccttatcgttgagcgggagcgtgaaatcaaggtctttgtgccagaagaatactggcaattgcacgcggacttaatggcaaaaggagacattgcgctccaaatggaagtcacccatgaagggggaaaaccattcaagcccgttaacgcacagcaaacacaggctgcggtatccttgcttgaaaaagccagatacaaagttcttgatcgtgaagaccgcccgacgtccagtaaaccgggcgcgccattcattacttcaacactgcaacaggctgccagtacgcggcttgggttcggtgtcaagaaaacgatgatgatggcacagcggttatatgaagcaggacatatcacgtacatgcgtaccgactctatcaatttgagtcaggatgcactggacatggttcgcggttatatcaatgatcactttggtgacaaatatttgccaaaaacagccaatatctacagcagtaaggagaattcgcaggaggctcatgaagctatccggccttctaatgtagatgtcatggcggaagaactgaaagatatggaagccgatgcacaaaaactgtatcagcttatctggcgccagttcgttgcctgtcagatgatgccagcgaaatacgattccactacgctgacagttcaggcggggaattttgaactccgtgccaaaggtcgtacattgcgtttcgatggttggacgaaagtgatgccagcattgcgcaagggggatgaagaccatactttaccagtggttgaagttggcactgaacttgacttgcaacagttgagcccaagccagcatttcacgaaaccaccggcacgtttcagtgaagcatctctggtcagggagttggaaaagcgtggcattggtcgcccatcaacctatgcgtcaattatttcaactattcaggatcgtggttatgtgcggggtgaaaaccgtcgattctatgcggaaaaaatgggtgaaatcgttaatgatcgtttagaagagaacttcaacgaattaatgagctatgactttaccgcaagaatggaagaccagctcgatcacgtcgctaataacgaagctaactggaaaggggtactggacgagttttttaccaatttcagtgaacagcttgatgttgctagcaaagatcctgatgaaggcggtatgcgtccgaatccaatggtgatcacttctattgattgtccgacgtgtagtcgcccaatgggtattcgcacggcgacaacgggggtatttcttggctgctctggctatgtgctatcaccgaaagagcgttgcaagcaaaccatcaatttgatcccggaaaacgaaatcctgaacattctggaaggggatgatgcggaaactaatgcactgcgtgcccgccatcgctgtaaagaatgcggtacagcaatggatagctacctgattgataaccaacgtaaattacatgtttgtggtaataatcctgcatgtgatggttatgaagtggaagagggcgaattccgaatcaaaggttatgatggcccaatcgttgagtgtgataaatgtggttcagaaatgcacttaaaaatgggtcgtttcggtaaatacatgggatgcacaagcgaagagtgcaaaaacacccgtaagatcctccggagcggggaagttgccccaccgaaagaagatccagttccattgcctgaattgccatgtgaaaaatcggatgcctattttgttctgcgcgatggtgctgctggtgtatttcttgcagccaacacgttccctaaatcgcgtgaaacacgagcaccgctggttgaggaacttgtcaagttcaaggatcgcttgccagagaagttatgctatttggctaaggctcctgttgctgaccctgaaggtcataaaacagtagtgcgttttagccgcaagacgaagcagcaatatgtctcttcggagaaaaatggtaaggcgaccgggtgggccgcattttttgttgatggtgcttgggtaacaaaagaaaagtaatgattttagtgatgggttagtatgtcagttcattgaaatatattcagatagatatttctttttttactaaaaacataatttttctttctaaaaagccagtcaattaggactggctttttttgtttttatatagaattaaaacataatatttctgcaataaatgtacgataatcgttatcatccccaattatttgttatataaatatacagcaggtgatatagtagttatatacctataaatatatattctgtatagttataagaaaataaccattagcaatatagaacatgtgtagactacaaaacattcgtacattttattattagggacagtgctgatatgaaactacagcaattacgttatattgtagaggtggttaaccataacctgaatgtatcttctacggcagaaggattgtacacctctcaacccgggatcagcaaacaagtcagaatgcttgaagatgaattgggtatccaaatatttgctcgcagtggcaaacatctgacacatgtcacaccggccggtgaagaagttatccgtatttcacgtgaagtactgtcaaaaattgattcaatccgttccgtagccagtgaacatacttatccggatcgtgggtctctgtatattgcaactacacacacccaagcaagatatgccttgcctcctgttatcaaaggttttattgagcgctatcccaatgtttcccttcatatgcatcaaggttcacccactcaaattgcggaagaagtatgtaagggaaacagcgattttgcgatagcaaccgaagcacttcatctctatagcgatcttattatgttgccttgttatcattggaaccgctctgtagtggttacgaaagatcatcctctggcagccaggcaaaacgtaacgattgaggaattggcggaatacccgattgtgacatatacctttggctttacggggcgttctgagttggatgttgcttttgaccaggctggtcttaaacctaagatagtattcacagcgacagatgctgatgtaattaagacttatgttcggttagggttaggagtcggcgtgattgccagcatggcgatagaacctgttcaggacagtgatttagtgcgcattgatatgcgtgataaattcagttatagcacgacaaagattggtttccgtcgcagtagtttcctgcgtagttatatgtatgattttatctggcgttttgctccgcatttaacacgagatgtggttgataaagctatcgcgttgcgatctaatgaagaaattgaagagatgttcaaggacatcgaattaccgatagcataaagaatctataatgaaaagatcagaggaaggcagctgatgttatcttcctctattttttgttgattttgtcatctagagttggtttaaaaataataactgatgcaaaaaaatcaggaatacgggattgggtttagctgtttctgtcgcaattaaaggatataagtttagtttgataatgtggtagccatcagttaatactgatggcttctttatttaaaaattaataatacagtgttgagacatgaataaaagagcaggttgcacagggtattgtcagatacacgaatcttttttatgataataatcacttttgtaacaatcagataagtaattttagctgtgccttaaattacactttaaattcaccgttgaaaaaattattagaattctctattgatgattttttgttattacgaataaatagatcaaaggatgccttaatttcgggatcttccaatgcctgataatcaaataatgaaatacaggaagagtaagtgaattcgacattgatattttcattggaagcacaatttgaagcaatttctgaattgcttctgtcaaaattcactttgtacagtttcattttgggaatataaatcacttgatcttcagctccaacagcttcaatgatactggccaaagtcagagtagagtaatgctcgttattcttcttcaacccaatcctaatagcatctccttgtttttgcaggaactgagaaaagcttttcatgctggaagagtttgtattcaaaacaatatccatgataagttgcagcaagttcgttgcgattgaaaatcctttcattacatggctgtaggtttggctttctatattcctgacgctcattaacggcagtttctctatgatatcgccccagaattgcacgtcagttctatattgttggccatgggtatttgcatattttatgatataatcagtcgcaattgaggaaagagaaatctgtgttttctttatttcatttaaccgttgtatcacgctggatttgtcattgatttgtgaagtaatgacaaattgaacaagtccacccatatcactgaattggtggtttgacagggaaaaattatcctcaattccactggaaaaaaattgttcagcctgcgctatatggtttaaatagtgttggcggtttttgtcgacttttatatccataattcaccctccagtatttaagtaatgatatttagtaccgcatgtgtgctttagctatgaataaaacacatgtgctttcgggatgtcatcactaaaatttgtcaataaatgagggtttacagccggttagcaaaatgtgtggtaactgaataacaaatgttcgctagtatgttatgtttaatggtgtagctgaccataataagaaaggaggagttatgtcgtttaaattgaaaacggactgtgcatcaacactctccattggcagtaaaacatatcattattacagtttatctctgttatctgaacaattgggtgagatagcccgtttgcctaagtccatgaaagtcctgcttgaaaatctcctgcgcaatattgatggcgattctgttgtggaagaggatttgaaggcattggtggaatggcagaaaaacggtcatgcagacagggaaatcgcttatcgtcccgcccgtgtgttaatgcaggattttaccggcgttccggctgtcgtggatcttgcagccatgcgggaagcggttctgcggcttggcggtaatgttgaacaagttaatcctttgtctcccgttgatcttgtgattgaccactcagtcatggtagacaaattcggtacagagcaggcgtttgaagaaaacgttcagattgagatggaacgtaactatgaacgttatctatttttacgttgggggcaaaaagcctttaatcgcttccgcgttgtgcctcccggaacaggaatttgccatcaggttaaccttgaatatcttggtaaatcggtttggtatgaaaaccagaatggcaaggattttgcctatcctgatacgttggtggggacggattctcatacaaccatgattaacggactcggtgtattaggttggggcgttgggggaattgaagccgaagctgctatgttggggcagcctgtctccatgctgatcccggatgtcgttggttttaaactggccgggaaattgcgggaagggatcacggcaaccgaccttgtcctgacggtgacgcagatgctgcgcaagcatggcgtggttggcaagtttgtcgaattctatggtgatgggctgtctgatttgccattggcagatagagcaactattgccaatatgtcgcctgaatatggcgcaacctgcggtttcttccctgttgatgatattacactgggctatttgcgcttaactggacgcaatgaagatgaaattgccttagttgaagcctactgtaagaagcagggattatggcgtaacgcaggggatgaacccattttcaccaacaaccttgagctggatatgtccacggttgaagtgagcttggcaggaccgaaacgccctcaggatagagtagcacttggcgatgtaccacatgcattccaagctgccatggaactggacatccataaaatacaggagcatcgggcggacacgatagtcactcttgataatcagacttttgcactgcaagatggcgctgtagttattgctgccatcacttcctgtacaaatacatctaatcctagtgtcttgatgacagcaggtttacttgccaaaaaagcgattgaaaaaggtttgcaacgtcaaccgtgggttaaaacctcgctggcacccggctccaaggtagtaacggattaccttgaactggcagggctcatgccatatctggaaaaactgggtttcaatctagtgggatatggttgtaccacttgtatcggtaactcaggcccattgccagagccgattgaagtagcgattaagcaatctgatctgatggttggcgcggtgctttccggtaaccggaattttgaagggcgcattcatcctctggtgaaaactaactggctggcatctccgccactggtggttgcctatgcactttctggtaatatgaaaaaagatctcactagggagccattagggcaagatcaacaaggtcatgatatctatctgcaagatatctggccggatagtcaagaagtcgctgaagctgttggtaaagtcaggacagagatgttccacaaagaatacaatgccgtttttgatggtgatgaaaattggcaatcgttggaagtggaaaggtcagaaacttattcttggcagcaggattcaacctatattcgccttcccccttttttcagcgatatgacgattgagcccaagccgataactgatatccatcaagccaatatacttgcgatcttgggggattcagtcacaacggatcatatttctccggcgggaaacataaaagctgacagcccagcaggacgatacttgcaggaacatggcgtttcgccgaaagattttaactcttacggttcaaggcgtggcaatcatgaagttatgatgcgtgggacgtttgccaatatccgtatccgcaacgaaatgatgcctggtgtggaaggaggatacactcgccatattccatctcaagctcagttggcgatttatgacgcggccatgctttatcaggaagacaagacaccgctggccattattgcaggtaaagaatatggttccggttcaagccgtgattgggcagcgaaaggaactaggctgctgggagcgagggtcgtgattgcggaatctttcgaacgtatccaccgttctaatctgattgggatgggcgtattaccactggaattcccacaaggtgtcagccgtaagacgctaaacctgactggtgatgaacgaatcgatattgtaggattggggcatatcgagccagggcagaccattgcggtaaaaatcaattatatcaatggaaaagaaactgtcattgatgtccgttgtcgcatcgataccaatacggaactggcgtatttttataatgacggcattttgcactatgtgatccgtaatatgctgaaataatagtagccgtataattcatctccaagaatatgaacatttagaaaaaaactgcgcctacaccgacgcagtttttatttttttgtagggataaacagagaaatttcagtttgatttggatagtagatgtcccatccggctggctttggtatctagataataagcgtttttaggattacgccccacgaccagtggtacacgctcgacgatattaatgcctgcttctaccatgatttcaacttttttaggattatttgttagaagacggattgcattaatacccagcaatttatacatatctgagcatagagtgaaatctcgttcatcagcagcaaagcctagttgatggttggcttctacggtatcaacgcctttatcctgtaatgcgtaggcgcgaattttattcagcagaccaatatttcggccttcctgccgatgatacagtagaacacctttaccttccttgctgatttgtgaaaaagcagcttccaactgaaaaccgcagtcacatctcaggctgaataaagcatcccccgtgagacattctgaatggatccgtgataaaacaggctcatcaccggaaatatcaccgaaaacaagcgcaacatggtcacgacctgttttaatttcttcaaacccaatcatcagaaactcgccccatggcgtgggcagtttcgcttcagctactcgttttagctgtattttagtattcatatgttgatttagcccgttataaatattgcgatacttagaacaataccggtttagaaatcagctaaaactacgtaaaaaattttttctgattacagcgtatatacgctaacggattataacagaaataatacacctgtccgtatataaaatcatcagatgaacggatgaagagaatgttaacatgctaaactataaacagatttttgcagatatacacaggcacataggatgtcgctatttgagtcaaaatgggtgcatttatcagcaaataaatagaataatgtcacaaaaaagagcaaatcaacatttgttgaaataaattgcttcctttgcgaggacgagaaatgttaatttaacgagccactatgtctgttatttggcataatcaattagcaacaatcgataacaggaaagaatgtgaaatattttctaattttattactggcactggttgtttttgtcatctcagtgactctgggagcaaataatgatcaggtagtgacatttaattatctgattgccaaaggtgattactcgatatccacactgctgtctgtattgtttgctatcggttttatgcttggctggggtatctgtgggggtttttacctgcgcgtctgtgtatcattgcgacgtgcgaaacgtaaaattaagcgtctggaagcccaattggaacagcctgctgagtcatccgtaaaaactgcatcgcctgtagtattaaccaaggaataattccccatgttagagctgttgtttctgttgcttcctattgccgctgcttatggctggtatatggggcgcagaagtgctcaacaagataaacagcaatctgctgaccgactctcacgtggatatgttgatggtgttaattttttactttccaatcagcaagataaagccgtcgatttattccttgatatgctaaaagaagatagttcagcgtttgaggcacatttaacgctgggaaatctattccgttcccgtggtgaagttgaaagagctatccgcattcaccagtcacttatggaaagtgcatctctgacatttgaacagcgtttgcttgccatccaacagcttgggcgtgactatatggctgctggtgtgtatgaccgggcagaaaacatgttcattcaattggttgatgaagctgatttccgtgagaatgcttttaactccttattaaccatctatcagtcaaccagtgactggaacaaagctatcgatgtttctgagaagctggtcaaactaggtaaacaccattttcgggaagaaatcgcccatttttactgtgagttggcactacaatgcatgggcagtgatgattctactgaagcagtagggcatctcaacaaggcggctcaggcggacaaaaactgtgcccgtgtgtcaattatgttcggccgtatttatatagcgcaaaaggaatataccaaagcggcggagctgctgaaacgtattctcgaacaagacaaacaactggtcagtgaatctttgcccatgctggaagaatgttaccagaacttgtctcaaccggaagaatgggaggcttttgttcagtgttgcgtggaagaaaaatgtggtgccattgcagaactttacctggctgatattatcgagaaaaaagaaggccgtgatatcgcccaaaattatattaaccgccagttagaacgccatccaactatgcggctgttttatcgcttgatggactaccatttggcagacgcagaagaagggcgtgccaaagagagcttgctccttctgcgcaatatggtgggtgagcagatccgcactaaacccgactatcgatgccataaatgtggtttcacttccctctcactttattggcattgcccatcatgccgttcatgggacactatcaaaccaatccggggtctggatggacagtgacagtgtcactattatgagcggctatatctgcgtgttttcattaatacatgtttcattacggacatgtttacttttcattagtaaattaaaggctgaaaaatgacatcccacacagctcaaactttaggtaagcagattgattcacctgttattgtcgcattggattatgacaatcaagacgcggcgttagcatttgttgacaagattgatccgcagtcctgccgtcttaaagtgggtaaagagatgtttacgctgaatggcccgcaatttattcaggtattgcatcagcgtggcttcgaggtgtttttggatctcaaatttcacgatattcctaatacaacggcaagagcggtagcagcagcggctgaattgggtgtttggatggtgaatgttcatgccagtggtggtgcgagaatgatgaccgccgccaaagaggctttgttgccatatggtaaagatgcacctttgttgatcgcagtgacagttttaaccagtatggaacaatccgatctgctgggcgttggtattgatgtgacacccgcacagcacgcagagcgtttggcgacattggcaaaacaatgtggtttggatggtgtggtatgttctgctcatgaagcacagcaattgaaagcagtctgcggacaggaattccaactggttacgccaggcattcgccctgaaaggcgtagaggctggagatcagcgccgcatcatgacacctcctcaggcagttcaggttggtgtggattatatggtgatcgggcgtccgattacccgggcagaaatccagcattggcattacagcagattaatcactctattgggatcgttcatggataataattctcgcttggtttattcgacggatatcggtcgggtccaagaggaaaaagttgagctttctcgccataaaggcgatggtatcgtgcgtatccaacgccagaccagtgggcgtaaaggcaagggcgtttgtataatcactggcattgatgctgatgaccaaacgcttgccaagctggctgcagaattgaagaaaaaatgtggctgtggtggctcagttaaagaaggtgaaatcgaaattcagggcgataagcgtgatttgctgaagcagttgctggaagctaagggcatgacagttaaactggctggtggttgattagtttctgtcttttaacaggctatgtataactggattgtatagcctgttaagtaatatgtagtaaatgggatagtgatcgggcagctgtgataaccgccaacttttggtcatttagttacgagtaccaaagacattgttttttttaaataatttattgattttaaatatgaaagtttcaatactccaacgggagcggatatagccaaactgctgcggtgagtatttcaataaatagagcagaataggcaaaaatagcgccaaattacatcggcggtgacgtccggcaggtaagctttgtaagtctatctatccatccatacttattaaactttcatacagaagagtgtatggtacaaagtgtttcagccacctgagaaacagatgagcctcaatacagcataagtatagccatgatacgatgagcatagtctttatctggtgtttttttgatctattttttcatctggctgcattcattttgggagattagtgataggatgtgcataactcagtcctttttgcgtatttgttgacttccaattcgaaaatttgcaaaaaggattgagtttctttaattttcctatcattttgaaaagcaatttaggtaagataaaatgagttggcttatcagtagcttcatcatttattgagaaaaaatttacaaattctatatatgaacaatactactaagtcaaaggtcagggcgaaacttcatattttagtacggttattgtggatataaattactcttttaaagttcaataaacacttaggttaaatactaaaatttatcaataaaattgtattaaatgtgcaaaattgttagcaatcgttaaacataaatttttttacaaagtaaaatcttgccctggttgaaatataaattttaaaagaagttaacaaaggaaataatgacgatgttaaataataaagctgtcatacttagcatattattaagcatagccaatattactggctcatcaggattgactatttggatagataatgtgctgaaagaagggggggggatattaaatacgtatattccgctcttttcttatttgatagggttgtctataggttgtatgacaatatctttttttattcgtaatataaaaaatatttttttaaaagaaaatatttttatatgttctttactattggcaacaacaaactgtcttctattttcaaaagagtggataactatatcagttttggctgattctatccatagagttatatggggaattatgagtggatttaccgttatattaggaaggaatattcttataacagaaggaaatgaaaaaaaacaaataaaaatttttctattttaagtctttctttattatgtcttccatttttaattccaattatatttcatctatatgatttaaatagtcgtacatctgcggatctatttgcttcaattatatacatgatatctattattatttatttggttggaagtaagaaaaaaacaattaaaaaaaattgaatgttactaactgcataattaaaaaaacaactataatatagttattctttctttcttgaatttagtaataataaatgtctgtttttttctactgttaatgattatgccagcaatgcgagtaatttattttaattacattgatatgactcaaatgtatataatattattaactctttggtttccttgtgctatttttagcataaagataattaagtcagccaaccttgaaaaaaaataataataggaaatgttatgcaattaatttcttttggtttatgtttgatttccataagtataggttctagaatattgtatatcttttttatgctgctaatgtttttagcaaatatgattatgcaacctgtttttttttcctacttaggattatattctaaaaattctctttatactctcggtatgcaatcagggatttatgtttttataacaacaatcattcttgcatacactgtttttataaatattgaaatggagaagataatgattggattcgcttcgttattaattctatccgtaataaattctattacgtttgtcttaatcgtcaatagaggaaaaaataacaaataaaattatccctataaaaaataactgttttaattttttgatgacagtcacaattatttaataatttggttgagtagatctgggtgtttgattagatggtgtcgtcataagacatttaaccaaagagcaagacagcggatctgaacagtagcaagaaatgaggcactatttttggcataacgggtcgctataccccgccagcgtttaagatgaagaaaagcattttcaactaaatgcctgagtcgatagagttcccgatcatattctcgtttcactttgcgattttttcggccgggaatttgcgctgccatgccttgtttttctgcttgttcaacaacggtattactgtcatagccccgatccgctaataaatgttctgcatctattccgtcaatcaaggcctcagcttgtgagcaatccgctgtgggaccgcttgtaataagtgctctgatcggcataccatgcgcatccacggccagatgtatctttgtattgagcccccttttgtgcgccccatatcctgattgcctcctgccgcccctgcggcgtggggatgaaccttaatatgactggcgtcaatcatcagccattcgaaatcgggttcaaagatgagttcttcaagcagttcttcccatacgcctttgtcccgccaccaacaaaaacggcgatgcgtatttttccagtcgccataatcgggcggtaaatctcgccagggtgcgcctgtccgtaaaatccagaacacggcattaataaataatcgattatcataagcaacacgcccccaggctcccttacgtcccggcaggtgaggttcaagcaaactccaaatatgatcggaaatatcgtgacggcggtgtacgggtgtgctcatggttaagtcatccattcatgtaatatagggttattattacatgaatttatttatgacgacaccatctaggaacctaccatgactacacaaaatatatttttcccgaaacaacagatcttgtccattctctccagccgtaaaatgacgctggaacaactggtggggattgcggatattcatcatgataatgtcgtttttccctcgcctcaggtattgcgtgatttttccgatcatattgctgtgccactaagtgtgttttatcaggaagatccgtgcagcgatctggatgatggggtaaaaattgcccgtcgtaatggaacattcagccgtgatgaaatccgtgatggagtgcattactacacctatcaccacctagtaaccaccaaagcggatcctggattaatggcattacgcctagatttacatagtaatgagacccagccactgcggcttaattccggtcatagcacacgcgaagtagtatatgtgacacgcggtacagtacgggtacaatggctggatgacgcgcagcaattacatgaggaaatcctcaacgaaggggactctatttttgtcactccgttagtaccgcatagtttcaccaaccattcgacacaggaaaaatccgagatcattgccattaattatgaataatatcgtagctatagctacttcttcctgtgctccaaacagacttgaggcgctgtatatcatcaaattgggtgacagcatatccatcaataaagatgatcgttatgaattgcactgggagaatttacagttaattgcggatattactgcgcaacggaaataagctttcattccgtatgaatgtggactccatgtcttgcatgaattgctcaattcatgcaagaccaagcacctgattaatcaggctgactggactaccgtggatgccactccgtaaagtgaacattggtattcgctatactgtgcgatcatttgatctggaaatggcaacatgtataacatcggatttattggcttaggccgtatggggcaggcaatctgtttacgactgttgtcccacgacattattctacgcgtttataaccgtacaccagaaaaggcgacgaaactgttggataaaggtgcagtgtggtgtaactccccggcggagcttggcgccgcgtgcgacattattatgttatgcctttcgggagagcaagtgaccgaggcactactgactgatagcgaaaacggcctgctgcgtcactgtcaccccggttgcatgattattgatactggcaccatctccccagaaagtgcgacatataatgcccatcttactgagacacagggacaggaatatatctcttgcccggtttctggcggcgtggaaggagcgaacaatggtacgctggcagcgatcgttgccgcgcagcctgcggtacgtacgataattgaatccgttatcagtcggtttgccgatcgaattacttggctgacaagtcacgctgatgcccagaaactgaaaataatcaacaatctagccgaaagcatcaatttattgggagcatttgaggtgctgaatatcggcctgacacacggcatcaccttagatgagttacacagcgttctgactacctgccgtgggcgttcagcctatatggatgtggcactacgtttcctcaacagtaacctgaaaccgagtgatgtgtcgttagctgttcgctgtaaagatttatgtctggcgggtagcttagctgatatttccagacattacccaatatctgacgcagcaattgagttattcagtcgggtgcgggaaaagtatggcgatgagcaggatcagtgtgagtattttaattttattaatgaggaaaagaaattaaatgacaattaatcataatattattctcgaagataccacgcttcgcgatggcgaacaggctcccggcgttgctttcacaggtgaagaaaaactggcgattattgattcactgatcagcagtggcgtgaaatggattgaagctggtataaacgccatgggtggtagcgaaagtcgcacactacatatgatgttggagcgtgttgagggcagtgatattcaccttataggctggaatcgtggggtgaaggaggatattgccgcttcgctagatctaggatttaaccatattcatattggactgccaacctcatcaattcatctcgacaatagcttggctaaaagccgttcttggttggttaaccaagcttgccagttagtggattacgccaaacaacgaggcgcatttgtctccatcagcgctgaggatgtcggccgttccgatcttgattttgttatagagtatgccactgcaattaaagaagcgggagccgatcgcctccggctgtctgatacagttggtattcttactccacaacagtatggtcacatcatcgagcaactaacccagaaagtggctattgatacccaatgccacactcataatgactttggctatggggttgccaataccatcgctgggctacatgccggtgcccgctatttccatactactgttaatggtatcggtgaacgtgcggggatgcctgatatggcacaaaccgtaatgactctgcgagtccattacggagtggatttggggattgataccactcacctgaaagcactatcgcaccaagttgccaacgcagcaggtattacgatgtacccttggcagccgattactggtagcaacgtattctctcatgaatcaggcattcatgccaacggtacgttaaaaaatagttccgcatttgaaccgatagctccggaaatggtcaatggagaacgcaggatcgtcattggcaaacattctggcaaagcgtcactgaagtatgctctgggctgtcaggggcattcctgggatgaagagcggctgggagatctactggcgttggtacgcgaagtggcgacactgaaaaaaggtgatttatcatatcaggctgtttgcctcctgtatgacagcctagtgcagagaggtgtataaaatatggtatcgttaaccttttaccggaaaactattgagcagttgttggcccgccgcaaaatggtactcaccgacatccgccatttggtttgcgtcagcgatgacagcgtggaggtcgaggatttcgatcagcttttcgccttaagccaacatacttctttatctgctagtgaatatattgcagcgcatcatagagaaaacgcggcacagaacgagctggtaaccatcactcgtaaggatagactgtacacgcgtattaaaggtgatgcacttcgtggaggctaccattaccgtcatgtccttaccacaacactggatcccgacctgttggtattacgaaccacaccgttgagcacccggcatcaagctcggccaaataccggacatcaggtgaaagaaatagtgtatgtgctgtcaggcagagtggggatagtctggcagaacaccggaggcaatgaacggcacagcaatttggggtctggagattcggtctacatagactcatgggtaccgcatgctttttatgccatcgagccggagtcacagattctggctgtagactacctctgactcaggggctcacttcggctgaaaccgaaatggcacaacctgctagtccagcagtgttgtgtccagtccggcttttaacggaacgcttttttagggaatcgcttggaagatgaaggtaatattacgtttaagaataatgacgaatagctgggataaccgctaacttttaatcatctacttcaatgggtaatctcgtgctcatatccagctcaaatatgctctaaagtccttttaaatgagcattttgttttttatctttcttgcgtcataatacgtgcagccgcagcaagaacatcattatgcgctttggcgtctttatcacttggttgggtaaaataggtcaccagaatcaagggagctttgtctttatcaggccaaatcaccgcaatatcatttgtagaaccatagtcgcagcgacccgttttatctcccacaatccaattatctggcaccccggcactaatgctggtaccgcctgttgtgttccctttcaaccactcaaccaattgtgtgcgttgtgttgcagcaagtgtgttacccaatgccaatttatacaggctgtcagccatagcctgtggggttgtcgtgtcgcgctcatcacctggcgtaaccatgtttaattcaggttctttacgatcaaggcggaatgcgttgtcaccgatagatcgagcgaatcgtgtcacactatgcgccccgcctaattgatccagtagcagattcatcgctgtattgtcactgtattgaatggttgcggcacttagctctgccagtgtcatgccatctttgaggtgtttttctgtaatagggctgtattcaacgatgtcagattgctggtagtgaatgcgctgatttaacaaatctttatcggtttcgctttttttcagaagagcggataccgtcatcattttgctggtgctacataatggaaagcgttcgtgtccacgataagtgattattgaatggtctgcggtgtcgattaatacaacgccaagacggccattggcatttttttccagggccgaaagttgattggtaatttgattttgttgagtagtagcatgggttggaaacggtatcagggcaccaagtagagggaaaatcgttgctgatattcgtgtgagtcttaatgaggaaaatggcatatcaggtatttccttaaggtaatggaaataatgttaacgggaagctggattgagtaaattatctcgtgctgattataaaactgccgcttgttattggcggcagtttatttactgttttttttaaactatttgtaatatcaggcaacagggcgtgccacaatattacgggtttccattctgacttcttcaatgcgtacattaataatgtcattcaaacgatgaacggcttcacccttaataagaacggaaccggtctcttgactgcactgaagctcatcacgcacggcatgtaggaatggccctggaacgaaagcgatagcaccattgtcaaccagacgaatgcgcaggccaccacgggtaatatccacaatctcagaagagaaagttttatctgtgccagcatgaggatgtaggaaacgggcatagagccagtcgcctacatcgcgttctgccatgcggtttgcgcgacgacgatctgtcagttgcaggcagacctcttcggatggcttttcttcttcggtttgctgaatgatagctttcaacaaacggtggttaataatatcgctgtatttacggataggagatgtccaagtcgcataggcatcaaagcccagtccaaagtgtgggcctggttcgggtttgatttctgcaaacgtttggaagcgacggatacggctatcgaggaattgagtcggttgttgatccaattcacggcgtaactggcagaaaccatccagttctagcagtgcatttgcttcagtttcaataccattttcttttaaaacgtccacaacttgatcaatttgtgttggttcgaaaccagtatgaacgttataaatgccaaaacctaatttgtcacgcaggatcttggctgcgcataggttcgcagtaatcatcgcttcttcaacaatgcggttggcagaacgacgttgatcaataacgatatcaacaacattgccacctttatcaaggacaaagcgataatctgggcgctctttgaaaacaagggcatattgatgacgccattgattgcggcgttcgcacatctcttgtaagagagtgatttgggtagtgactgcttctgattctggtttccagccggcttggtgttccagccagtcagaaacatcgtcgtaagccagtttaaatttcgattccacccatgcagcgaaaaattgcatgtcatcgcccaattgcccatcttccagaatggaaacctggcaaaccagtgcaggacggcgaacgtttggccgcagcgaacataaatcatcagagagttcgcgaggcagcataggaatattgaagcctggcagatagttagtgaagctgcgctggtaggcaattttgtctaattcactgtcagccttgatataggcagttggatcggcaatggcgatggacaatttcaggctgccatcaccatttttgacgatatgcagcgcatcgtccatgtcctcggttgtcgcactgtcgatggtgacaaaatcgagagcggtcagatcgatacgctccagcgaaccatcatccaactgacaatcgggcattgttggagcttcacgttgcagattatggcgtgtcagagttacccaccaaggtgcgtagtgatcatcacctttggtaatgtaaccggtaatttcagcctgaaatccccgatcacctttcagtggatgacggcgcatttcagctactgcccaatcgccattttcaaaattatgggtgacttgattagcaggacggcaaaggattgtatcttttaataatggatgatccggaataatccacagtcggttgtcgttctctttcttttggactcttcctacaaaacgggtcagaaatggctcaatcaaggcttctggttcagcgatttctttctctttatcggtgtgaatggcggcggtaatacgatcgccatgcatcactttcttcatctgtggtggtggaatgaaataacttttctggccatcgacttccaaaaatccaaagcctttttcagttcctttaactaaaccttctacgcgtagggtctgagcgtggagttgctgttttagctgtgcaagcagcggattgtcttgaaacataataatctggggaatatggagttattatcgataattttggataacagttttacgcgaatcaggggtatggagcaagtaacatcttatcaaaacacgcaaaactgactaaaaaggccaataattacacagcttatatctgctgaaagcgggttccttcaggcgattggtcaatgtcatcaaattttgttgtgggccgatccttcctacaattcatggtcaagtgtgcgatagacggttggctgggggatggagaatggttcggccagattgctgatcgagggttttcctacacaatatatgaacttatggataatttatttatatcgctgttctacttaggtatttttatcactcggttttatcagcatactcacacagatcctcaataatacaagatccacagcgaggtttacgggcaatacaggtatagcggccgtgtagaatcaaccaatgatggcaatcaagcttgaattcatccggtacaactttcagtaactttctctcgacttcatcaacgttttttcctggggcaaattgggtacgattgcagacacgaaagatatgcgtatcgacggcgatagtcggccagccaaaagcagtatttaaaacgacattagcggtcttgcggccaactcccggcagtgcttccagagccgcgcgatcttccggtacttcgccctggtgcttttctaacaaaatacggcaggttttaatcacgttctcggctttggtgttatataacccgatggtttttatatactctttcagactgtcaacacccagattgaggatcgtctgtggagtattggcaaccggatacaactttgtggttgctttattgacgctgacgtcagtcgcctgtgctgacagtaatacagatatcagcaactcaaaaggagaattgaaagccaactcggtggttggctgtgggttgttattctgtaagcgggttaaaattgcgatccgtttttgttgattcatacctgattacgtccttagcttttcgtgatatggctgccacagcctttttctacgttgtcatagcgacgtgcttgattatcagcccgatttttgatgcgttcatcaatgatgtattttcctgccagcatcaagcctaatccgataaatgcacccggtggcaggatggctaacaggaatggagaatccatatgcataatttcaatgcgtaatgattttgcccaacttcccaataacagatctgcgccatcgaaaatggtgccatttcctaagatttctcgtatggttcccagtacgaatagggaaaaggttgcgccgagccccattgcaaggccatcaattgtggaattgtagatcgagttttttgatgcgtaagcttcagcacggccaatgacgatgcagttagtcacgatcaaagggataaatatccccaatgactcatataatccgaaggcgaatgcattgattaacatctggacggcactaacgacagaggcaatgatcatcacataaataggaatgcggatttcatggggaacccagcgtcgtaaggcagacacagcaatgttggtacttaataaaaccaacgttgtcgctaaccctagccccagagcattggtggcagtagaagagacagccagcaaaggacaaagccccaatagctggactaatgcggagttgtttttccataacccctgagaaaatagtttcttggtttcactcattattcaactccacaagttggtagtgaagaaagttgtgcgggaatggttttcagatagagggttgtccatttagctgcatttacgacggcacgaggtgtgatggttgctcctgtaaattggtcaaattccccgccgtcttttttaacagcccaatgaggatcgttgtttgaaacgacttttttgtcagaaagagaatagatccaattggaaatacgtgtgtcaattttatcgcctaaacccggtgtttcatgatgttcagttacacgaacaccgaatacattgcctgaaaaatcagcacctaccaataattggattgcacctgaatagccatctggtgcggtactttctatcgccgccgcaacgggagagccatttttacgggcgagataaagtcgatggggttgtttgttgcccaatgcatcagccgtcaccacatagcattcatcttgcatattattgttatacagtgtgggagggacaacttgatccagcagtatcttgtgttgtagtgcagcttgctcggcaatccgatcttttgtcaaagaatagacgatggcagtcagccctgtagtgcaggccgcaaaaattgcgagggtaatcccgtggcgtcgcatggtttctaacatggaatccccttatttatggccataagcacgaggttgagtgtaatggtcgatcagtggcacgcagatatttgccaataagacggcaaatgctatggcatctggataaccaccatatacacggataatccaaatcaacacgccaataatcgcaccgtaaattagccgtccttttgctgtggttgatgcactaaccggatcggttgcgataaaaaatgcgcccagcatagttgcaccggaaaaaatctggagtaaaggtggtgaatagctggttgggtcgatgagccaactgagcaaagcacaggtgcacagcgctaaaataaatgcggttgggatctgccagctaataacttttctattcagcataatcagccccccaatcaggtaagcgacattgacccactgccagccaataccgaccaaagtaccttgtaatattggttgctgtaatacctcatcaatattatgggtcaatctgccggttttaaagctgtccagaggcgtggcttgactgagcccatcaataccttgttgtaggtgaagcaaagtagaaccatcaagcgtatgccctgtaaagatcaccatcaggcaatcccaaggggtcaacgtgagtgcctggaaggacactggtggcagccagcttgtcatctgtacaggaaatgagataagcaaaacgacataacccaccatggcagggttaaatgggttttgtccaagcccaccatacaggtgtttggcgatgataatcgcaaagaatgtgccaagtacgatcagccaccacggtgctaaagggggcaggctgattcctaatagcaatcctgtcactagcgctgagttgtctttgaggaatggagctatcacctgttttttcatggcaatggctacagactcagcgagtaaggcggtaataactgccagcaagatctggaatagggttccatagccaaatagataggtttgtaccgcaataccgggtacggcggctaaaactacccacagcatgagctggctggtacttttttgattgtgtgtaaaaggcgaactagcgacttttagctggttattgtcagtttttactggcctaaatttcatcgataaatgtcactattctgttggagttttttgtttttcaagcgctgcttttttgtttttcaagcgctgcttttttggctttcacgcgtgcgatagccgcagcgacagcagctttgcgtggatcagcctcttccggtacagcggtaacatcttcttgctgtagcgtaggtttggactgattttgcgcggcttttttagctttagcacgggcgatggccgcagcaacggcagctttgagtggatcagtctcttccgatacagcagtaacatcttcttgctgtggcgtaggtttggactgactttgcgtggcttttttagctttagcacgtgcgatagccgcagcgacagcagctttgcgtggatcagcttcttccggtacagcggtaatatcttcttgttgtggcgtaggttcagactgattttgcgtggcttttttagctttagccctagcgatggccgcagagacggctgccttacgtggatcttgtttatcatccgcgttatttggtgaatctttttgtgacgttgtcaccttttcactttgagtcgcctttttcgcttttgctctggctattgcggctgcaagtgcagctttgcgaggatcatcgctttcagttggtgtggcgggttctgtattgacggttattgctgctggtttctcttcctgacgaatacgcaattgctcttttctggctttacgtgctgcaatggctgcttcattatcaggtaattgcccagcttgaacattgatagcttcaccagcattcttctgtttttctttcactcggctaagggccgcctgtatagcgctttgatctttgctatccacttgaacagccgattttttatggcgttcctcgcgagccagtttttcttgttccatacgcgtttgtttggcttcaaagcggattttggcttcggccgaacggcgtgtttctgcatctatggcgcgtatttctgctttttcctgacggtagtattgaaccaaaggaatattgcttggacacacgtaagcgcaggcaccacattcaatacagtcgaacagatgatgatttttggcttttttatgttcctggccgcgactgaaccagtaaagctgctgaggtaatagacccgccgggcaagcttcaacacataagccacagcggatacaggcctcttcaaccgttttcggttccatttcttgaatggaaggggcaagaatgcagttactgattttgacgacaggtacgtttaaatctggcagggtaaaacccattaatggccctcccataataaccatctgttctggcttggctttgaatcctgcttgttgcagcaggaattgaacgggagtacccagacgcgcccagaaatttccgggtgcagtaacggcttctccagtcagagtcacgatacgttcgattaacggctctccatcgataatagctcgtttgatggccatgactgtgccgacattctgcatgagaacaccaatatcggaggaacgcccaccagatggtacttctttgcctgtcaggatcttggtaagttgctttgcaccaccagacgggtattttgtgggaataacacgtacaacgatggagtcgtcaccattaagagcggtattcagcgcatcaatcgcttcagtcttattatcttcaataccaatcaacactcgctctggattgagtaagtgcatcaagatgcgtataccttcaataacttcgttggcatgttcttgcatcagacgatcatctgctgtgatgtacggttcacactctgctgcattgatgatcaacgtttttagatcgtgccgactaccttgtagttttgacgcggtagggaagcccgcgccacccagaccggcaatacctgcttgttgaatgcgttgcaataaagtgctggtattgagggaagtgtaatccgtggtttgaatacgttcacaccatttatcttcaccatctggatacaggcggacacataattctttcagtccggaagggtgagtagtgacacagggttcaattgccgtgatagtccctgacgtagatgcatggactggtacggtacggcctgtaccaaccgtcaaaggctggcctttcagtaccttgtcaccaactttaaccagtaattcaccttctgggcctaaatgttgttgcagaggaataattaattcatccggtagtggcgcgtggcgtaatggggtacggctggattgcagtttcatttctggtggatggataccaccctcaaagtcccagattttatttttgttaagcaagttgaacagattaaacattagctttaacctcaacaggcttagtaggagaaacaaagattggattaatcggaatatttctgaccggaatggaattcaaatcccatttccagtttgatgtagtagtagcgacagggatcattgtgatgcaatctgttggacaaggtgcgacacacagatcacagccagtacagagatcttcaactacagtgtgtattgcacggtttgcgccaataatggcatcgaccggacatgcttgaatgcatttggtgcagcctatgcagttctcctcatcaatgaaagccacctttcttgccggattctgtacactgtcatcgccatccagcggctgagggtcaacacccagcagttctgacatcttgagcattacctgctctccgcctggagcacatttgtttatcatctctccattattggcaattgcttctgcatatgggcgacagcccgggtagctacattgcccacattgactctgaggcaacaggttatcgattttctcaacaataggatcttcttctactttaaaacgacgggcagcaaaacctagaattaagccaaaggctaaccccagcaggctcaacacaccgatagcaatccataatgacatcattagaatttcaccaaaccactaaagcccataaatgcaagggacatcagccctgcagtaataagccctatcgatgaaccacgaaaaggggcaggaatgttggcaactgccagacgttcacgaatggcggcgaacagtaccatcacaagggaaaaaccgactgcggcgctgaaaccatatatggctgattgcagaaagttatgtgattgattgacgttcagcaacgcgacaccgagaactgcgcagttagttgtgatcaatggcagaaaaatccccagtaaccgatagagcgtcgggctggtttttcggacgaccaactcggtgaattggacgacaacggcgataacgaggataaaactcagtgtgcgtaaataaactaaatccaatggtacaagaataaaggtgtttatcagccatgaactgatggaggcgagggtcagaacaaatgttgttgccagccccatgccaatggctgtttcgagttttttggaaacgcccataaaaggacataagcccaaaaattttactaaaacaaaattattaactaacactgtgccaataaacaaaagaaggtattcagtcattgctatacctgaaaataatatatttgaaagtaaagtactgtttatagtcaatgaaaatgacagagattgccccatcttgcgatgaaacaagcggggcaatgataacaatcgattgtgggggatgttatcgatcttgtgtgaaagtcattttcacccgatgggaacgcttgatataaggaacgaaaacagcggcagctaatagcggccataacagcgaacgaatagccatctcgtcagaaatgggggaaaaggcgaaggtttttatggcaattagaacagagaccatgagccagataataaagatacgcgggaatcgttttgaacgaataaaaagcaactttaatacccagagagtaaaacaccacatcattgccgtggttaataatgatatataccacatagtggtaaagtttccgtctacttggtggacagcttcgtttctgtagatgagcgttattaaatatagcaacagcattaaactggccgcaataagtgtcataatcagataggcggcgggagccaataaccagccgttaatacggtaataatcattggattgatacataaagaatcttcactccatgatgagcgttttgatataggaaaaagatagtaacacaggaactttgattatttgctaattggtgaaaggtggtgatattttctgacctcttgagacccgttagctgtattacaaaaattttgagaggcggttatgagtgattttttaaaggttggcctagtagggtatggttatgcaagtaaaacgttccatgcgccattaattgcaggtacatctaatgttgaattagttgcgatttctagcagtgatacagaaaaagtcagaaaagattggccgactgttactgtagtttcctcgccggaagcattattcagtgatccagatattgacctgattgtgatcccaacgcccaatgatactcattatccattggcacagaaagctctggcggccggtaaacatgtcgtagttgataaacctttcaccattacagtggaagaagctgaagcacttaaaaagcaggcggaagaggctaacttgttgctgtctgtcttccataatcgccgttgggatgccgggtttttaacagttaagtcattgattcaagaaaatcgattgggaaaattgaaatattatgaatcccactttgaccgttaccgtccggtggttcgtcagcgctggcgggaagctgcgggagctggtggaggaatttggtacgatttggggcctcatttattggatcaggcggttcaactctttggtaagccacatgctatcaccgtggatttaggtatgattcgcccaaatgccgaggcggtggactattttcatactcagttgaattatccagatttgaaagttgtattgcatgcaacaacggtcgcagcggcagagtctccgatttatatactgcatggtatggaaggtagttatgtgaagtatggcttggatacacaagaagagcgtttgaaagcaggggaaagaccaccacggactgattggggatacgatgtacgtgatggaagcgtgacgttgtcacaaggagacgatttgataacgcaaattattccgaccttaccgggcaattatgggacatattatgcggctatccgtgatgctattgtggctggaaaacccaaccctgtgactgcaaacgaggctattttgatcatgaaactgattgaatccggtgaaaaatcagcaaaagagcaacgcacgatccttatcgactgggaatgatagagcaaagggagcaatattgatgagctggtggcagaaattaagaatcgacccttttctggtaacactaattacagtagtgatcatagcaacgcttttcccctgtgaaggagaatcgaaaaagtggtttcaatatttgacgacagcggctattgcacttctgtttttcatgcatggagccaagctgtcccgtagtgcgattttagcgggaattgggcactggcggctgcatctggtgattttcctgagtacctttgttttgttcccgatattgggaatgggactgtattttattgtacctgaatggctgtcgccaacggtctatatgggatttctttatctttgtgctttgcctgctaccgtgcaatctgctatcgcctttacttccgtagcaaagggcaatgtcgcagcagccatatgcagtgcttcggcttccagtttgttgggtgtgtttatttctccattattggtcggcttgttgattcagactaatgatggtggtggtcatactgatacgtggaaagcgataaaagatattatcctgcaactaatggtgccatttattgccgggcacctaccgcggccactgattgccagttgggtggaaaaacataaaaaattggtcaacacgactgaccgatcttctattttgctggtggtgtatgttgcattcagtgaggcggtggtggagggtatctggcataaaattgatgcttactcgcttatgatgattggcgttgtgtgctgtattttattggttatggtattgatgatcaatgtatacagctcgcgtttgtttgggttcagtaaagaagatgaaattactattgtcttctgtggctccaaaaaaagcctcgccaatggtgtaccgatggctaatgtattgtttccggcttcaatggtaggtgtgatgctgctaccgttgatgatttttcatcagattcaactgatggtttgtgcagtacttgcccagcgttatgcaaggcgtccaaaaaaggcagattaactttctgccttctcaataaagactgcttttagcagtcttctagcgatttgcagccttggctttcagcgcttgtttttctgtttcactgaggaatgcagttttcaatccattaatctgtgcttgtcggatttgttcgggtgataacccagccgcaggcgcagcaacgttatattcgtggcgaatttctatcccttcaactgctgggtcatctgtattgattgatgccagaatgccatgcgcaaggaattgtttcagcggatgggctgacagggaatttactgtactggtttgcaggttcgatgtcagacaagattcaataccgatgccgtgttttgctaggtaatccatcaatgcgggatcggtaattgccttcacaccgtggccgatccgggttgctcctaaatcacgaatagcgtgccaaatactttctgcaccagcggcttctccagcatgtacactaatgttccaacctgcatcacgtgcttggataaaatgctgctcaaacagatgaccagggaagccaagctcatcacctgccaaatccagcgctgtaatgtgttgtttatgaacgagaaggctcgcgagttcctgagaacaggccttttcgccaaacgttctgcttagaatgccaatcaaacgtatctgaacatcaagttgctgactggcagaatgaataccatcaattaccgcttcaaccacaccttcaacagggagctgatgtttcatcgccatgtagtaaggtgagaaacgcagttctgcataatcaagctcagcattgaccgcatcttcaacgttttcaatggcaacacggcggcaggcatctaaatctgccagtaccgctactccccaatccagtttttgcaggaaactgataagattaggttcgttttcagtgatctggacatgaggacgcaatgcttccagctcataagctggtaacgggatattatgctgacgggcgagttccagaatggtttcaggacgaatgttgccgtcaaggtgacggtgtaaatcggtcaggggaagccgtatatcaatcattttttatccttattatcaaacagatatatacaaaaaagccagtcaacacattgactggcaagaaaatgaaagtactatcggagtttttgcgatgcttttgctttgtaggttttttaaccctaagcatgtactttcttatggtgactttcttcaggtttgggtatccgtaatagacagacccgtatatataatcaaacgggtctgtctgccatcttaggagccgattaagtgattatcaagcaagaattgatgcaagtcggattttttgttattcaattcaactttatcattggcatagtggagtttaaggccgatcacgttattctcatcggtgaggatcttaaacgaaacaccttggctggctatcatctgtacttcttgagtagcctcggcttctgcggcctcttttgtttttccatcaagtattttggcttgagtgatagattctatcaacataggtttggggatcttaacatccaaagatagttcttgaaggagggtacggatcatttcttccggtcccatgaggatcagcgagtctttattttctggtatgtttttcaatgcgagtttgaagtttaccgagctttcgcctttactgtttttccattttatcggctcaaggctgaattgcggactattattaaacagcagatgtgcgttttcgataactttattagacactgaatcggtagatagagcctctgaagtcagtacttttgccgtggcatcgttataagcttgactaaatttacggactgattgaccatccagattactcataccgataaccaattgacctgagccaagatccatgttcttgagtttgaggccatcaatgccataagagacattcagattcaggttcttgtcagtttctcctaccttagaagttattttcattcccttgagagagaagctgtcatcactcgttgaactcaaggtgatttcatcaatattataattttgatcgccaagatacaggtcgaatttacctttcttgttgtctcccttaaagccaatgcctttaagagtcagctcttcgtgtttggaaggagagctgaaaatcagcctatcgcttttcacatcaaatttgaaattacttaaatcacgggcaatttcagcatcgatttttgcacctgaaaaaactagtttattgccatttttcgctgtgtaatcaacaggaataaagtcaatatcagtagaaaggctactgctataacctattttggtttccatggtgagcagggatttacctttggtagcttcaaataaggcttttgttgcttcgctctgttctagctctgaatggatagatgccattttcggaaccagatgaagttttttcaggtcagaaatgggtaacgggccatgccctatactggatttgaagataatttcttcatttggtttgatgtccgtatttttcacgccatctttgattttgaggatcaagcggacatcagaactgaaaacaccacgttgaaagtctttcgtttgccattcaatagcactttcaggaaatgattttgcaagttgagtgtttacagtcttaatgatgttattcaggcggccttcaatttgtttccctgtataccatgatgcgcctatccatgctgcacctaacgcaacaataacacctacagctactaacgattttttcatgtggaaattccatcctttttatgcatacaacattacggaagtatgcgttctgtctttaatgtcgataatggttgttaattgtatagtttaactaaaaaatttttaatcaattttcaataaaagagtcattaacaaccaatgaaaagggtgtagccctatggatctaaactcattaattagatactttagcaattttcccattaccatgaacagtcaagtttttttctatagcagataagaaaactgattcacctgagaataatctcaattgctgttgctgttcatccgaactgataattatttgaccttcaaagcaaaatagaaccgaagcagaatcatttttcagtgttattggctgttctgaaacatcataaacagaaaagtaaaaatcattgacaggaacagggtaattcagagcatctttttcctgttttgggagagtcagtaaagtatcggcgggtttggaaacaaaatccagattagccatcaactcggcaacatcaatatgtttgctggttaagccggcacgcagaacattgtctgaattggccatgacttctaaggccacaccttcgagataagcgtgaggtgtacgggcatagagaaacatagcctggcctggtttcaattcaactatattaagcagcaggggggtaaataaaccattatcatcgggatagaagccagccacttttctgatagtatcccaaggttctccctctcgattgttcagcactgatttcaagacggcgatcgccaaacgtttttgttcgccttgcatagtcagcaactgggaaaagagaaacgatagatgcgattcagtcgggttctggataaatgcctgaatatcgggatgtgcggcagaaacagggccaagtaattgagcaatgtctgataaaggccgaaaggcattcattgccttaaacggagtcagagcatacaccaattcaggcttatgattatcatctttgtagttgcgctggagtgaatttaaaggaataccagctgcattttctctgtcaaatcctgtttctgccgatgatttgtccggatgtacttgaatggaaagtggctgggctgcgcataataccttgaacaagaacggtaaccgctggaattgttcaaccactttttcccccagatatttttctggctcttgggctatcagtgcattcaacgctatggtctcacctgttttgggatccgtgacctgagaactgcatttcggatgtgcacccatccatagttctgccattggctgattatttggattcttaataccgtagatgtccgtcagggcggttttacttccccagtcataatgttggatctggttggtcattttcagcatggcaagactccctataataaaaaaataaacttatttatatgacaacaatacaataaacacgatcaggtcgcattatggataataaatttatggcatgataataaaatgccgactaatttatctgcaaattttgatccggcgtattcaattattctgtgtgctaaggagatagtaatggcagccactcgcattgaaaaagactcaatgggacctattgaagtacctgctgaccaattatggggagcgcaaactcagcgctcactggagcatttccgcatttctcaggaaaaaatgcctgttgcgctgattcatgctcttgcattgactaaacaggctgcggccagtgtcaatatggatctgggccttttgcctaaagaacgtagtgatgcaattattgctgcggcgaaagaggtattggaaggcaaacacccaacagagttccctcttgctatctggcagactggttcgggaactcaaagcaacatgaatatgaatgaagtgttggcgaaccgtggtagtgagatccttggcggtcagaggggtaatgaacgtctgattcatcccaatgatgatgttaacaaaagccaaagttccaatgacgtttttccaacagccatgcatgttgcagcagttattggattgagtgagcagctattgcctgagttgaaagcattacaaaaaaccctggcagataaagcggtagcatttaaagatatcgtaaaaattggtcgtactcacctgcaagatgcgactcctctgactctgggtcaggagatttctggttgggcggcgatgctgactcataacctgaaacatattgaagatagcattcctcacgtatgtgaattggcattgggcggtacagcggtaggaactggcctgaatacgcaccctgaatatgctgttcgcgttgcgaagaaaatcgctgaattatctggccaacctttcgttacttccccaaataaatttgaagcactggcaacttgtgatgcattagttcattcacatggatcattaaaaggtctggctgcatctctgatgaaaattgctaatgatgttcgctggttagcttctggtcctcgttgtggtattggtgaaatttccattcctgaaaatgagccaggtagctcaattatgccgggtaaagtgaatccgactcagtgcgaagccatgacgatgttgtgtgcacaagtgatgggtaacgatgtggcaattaatattggcggagcatctggtaactttgagctgaacgtattccgtccgatggtgatcgataacttcctgcaatcaattcgcttgttagcggatggtatgcgtagtttcaatgagcattgtgctgttggtattgaacctaaccgtgatcgtattactcaattgctgaacgaatctctgatgctggtaacggctttgaatacccatattggttatgataaggccgcagagattgctaaaaaagcacataaagatggtctgacgctgaagcagtcagcgatgcaactgggctatttgaccgatgctgaatttgacgcatgggttcgtccagaagatatggttggtagcatgaaataattctgactacccagtgacaaaattaagtcattggcgatataaaccggaggagaaatcccccggttttttgctttatatttcccgataaagatgtaagcgtgggataactaattcaagtggtttggctttgggtttatatcggtgcttgatggcattggcattataatttgataatgtacctatcttcggttttatttcgcaatcgtctgtataaaaaacaataattggcaatggacaggcatattgcacctgtttttgcagttctgaataccaaactcgggtaatgggctgaactttgacaggccttttgattttcaatatcgcatcatcaggtaatttcttaatatccgtgatttctaatgcaaccaatgcagcccattgatcgctagagtagggaggaaccgctcgtccagaattataacttttttccaactgttcaagaacttgttgtttggtgactttattaatgatgtttttattcgcccaaccaaaattgatagagtctggattcatgaggggagtaatagtgcggtaggcattcaaggtaattaaaccgcgtagatgatcatggacaaattcaaatctttgttctttgctgacgcctgactctttggttacgatattttccagttcggccttaagctggttaacttcattgataacgttcatcgctgttttatattgctggtggctaacagcaaaacataacgcaccaggtaaccgacttgcagctttgctgctgatattggggtggttatggtgtatgaatagcttttggtagaaatgtagccctaagttgagagcgtcatttccctgtaatgggttgactgcaatttcagtaatctgctcatgttcttcgcctttttcaatttgaggcaattcaaacacccgcgcatcaatgagcgggtagtccatcaataatccaactagttcagccaatttttcttcctgttttttgaagctggacgtaagtgattctattgaaaagtatttattcataaggactctcagcgataaatgatgtggctttttcatttatatttagttacaacatacttattagtataacaacaaaaggagcagatcctcaacaaaaaacaaaaaaaagcccaataagcaacaaaaagaaaaacgtctattgcgaaacatttcactgttgtgataaaaatcaaaaaaggaattactgattatctaacaagtttcaataagtatttatgtaataagtataagaaaaactgttcactttatatcgttgatagagtggggccaaacacagcaccaaggttgtttaagatgaaaaaattagtcaagccagtgaattcctttgaaaaggtggttgatacgttattaccgtattctgaattaattgcttctgatttaccgacacaaggtaaattgcttaaagttgaaaatgaatttgctaaattttttttattgcagcaggggtatgtaaatatacgaagagtagatgacagtttaatcattgcaacggttttttcaccttatattatagggttatctttctactctggctctgatgtctattattccattgaacttggccctcattgcagactatatcaactccctcgtattaatgctttgaatgctataaaaaaacatgatctttatagagaatggatgaggataatttcatacaagatggcttttttatatgcaagagatgtcagtatttttcgtcctggagccaaagaagttgtgtgcagtctattatcccgacttataactctacctgctgaatttcatgaaaacacatctgttatcaaatatatagaacaaagatgtacgctttcacgcagttgtatacaacgtgtattatcgtcgttgaaaagagaaaattatattgagatgattgatgggcatttagtaaaaattaattcattgccgattcattcttattattaaagtgaaagggtgaaaaataaacaatttaatgatgttgaactttatctggtaaaaaattgccggaatatatttatggataccggcagttttattttatcattcttcagatttgttgagttttaaacctaaatacagtgcgatgattgttaataatgacataaatatgactacaccattccattgaaaatgcagccaaaatatgccacctaatgttccagcaacgctagagcctgcgtaatagcagaataaataaagggatgaggcttgcgctttggctcgtttagctcgccatccgacccatccactagcaaccgaatgagcagcgaaaaatcccgtagttagtaccatcatgccaagcataattgcccagatggaagaacatattgtaatgaaaccgccaatcaacatcatgctgatcgcaaccagcagcacctttccacgcccatgtttatttgtcaaagcaccggcttttgtcgcactgtaagttccggttaagtagactatcgacaataatccaataatagtttggttgaaatggtaaggtgcacccaatagccgataaccaatatagttaaacatagtgacaaagcagcccattaataagaaggcttcagcaaacaataaaggtaggccttggtcacgaaaatgcagtttcaggttgataaacaaggtattgggttttaatgaacttgctctaaaatttttagagggtggtaacattttccaaaatgcgatagctgcaattagtgcaaatgaacccagtaaaatgacagcaaaccgccaaggaaaatgatccgcaatcacacctgtaatcaaacgcccactcattcctcccaatgaatttccactgacgtaaagcccgatagacaacgcaacataactgggatggatttcttcgcttaaataggtcattgcaacagcggcaacaccacttaatgacaccccaatcagtgcgcggacaaccaaaagcccgttccagctcgtcactactgtactcaagagtgtaaaaatggcagcagcagccagtgatactaccatgacatttttacggccaagagcatctgataaaggacctgttatcaataagccaagagataacataccggtggatagagatagtgccaagctgctgcttgctggggagacattaaattcctctgataagatgggcaatataggctgaacaaagtaaagtaacgcaaaagttgctaatcctacggcaaagaaagatagggtaacacgaagatatacggcatcatctcgttgaatatagcgctgttcattttcatgccgtcgattgatttcaacatcactttcaacatcactttcaacgtcaggaactgctgattcttcaccgacgcttggggctgtattcacgttacttccttaatttatgtaaaaaaatgctagcgacttgattttgatcaagaataggaactcatgaatattttgtctaatatattaatcatcatgaatgatatgtttaaaatattaatatggtgataattgatgagtataaacattgaattaaggcacttacgttactttattgcggttgcggaggaattgcatttcgggcgtgcagcggaacgattgaacatctcacaaccgccattaagccaacaaattcaggctcttgaaacaagcatcaaggcacagttactggcgcgtaataaccgcaatgtcagtcttactcccgctggaaatatgtttcttaaggaggcataccagatactcgcccaagtagatgcagcggcaactaaagccgccagaatgcagcagggtgaactgggagagatatccatcggttttacatccaccacacctttcatgcgtaaggtcactctcagtttacgtcaattccgtgaacgttatcctgacgtggccattcatatgcatcaaatgaacaccaagcagcaaatagcacctttgcagacaggtagaattgatatcggggtcatgcgtaatacgttattgcctgataacttagagcatcgattacttttccgcgaacgctttatgctcgcggtatatgatgggcatcccctgctgaattatgctaacgaaggtatcagcttagaaatgttatctggctatccactcgtattttttgagcgtgatgtaggaacagccttgtatgatgaaattatctctctgctggctaatgcaggagtcacccctatgatttcacaggaagcgggggaagcgatgacaatacttggattagtcgctgcggggttagggatcagtataataacggaatcatttacccggatgaaaatcgacggtgttcaatatctccatttagcaaatgctcctgcctgctccgaagtctggttggtcaatcacaagaatcgacagaatagcgcggcagtagaccgattaaccaatctcttaatttcaaatattgttgatgaaagttgttaattacacgtaataatcacgagaagttcgtgtgaacgatcacatttctactgtaaacggatatcttctaatttaaacaaggacataatcgttactcattatttagaggcacaaattaaataacgggaggcgaagtgagtgtcgatattcagccaagtcacgttgaccagataaaacagaccaatatcggtctggtttatcggttaattgatcaatatggtccaatctcacgtatcgcactttctaaaaaatctcaactggctcccgcaagtattacaaagattacacgggaactgattgatgctcacctggtgaaagaagccgaatttcccgatctgagttttcgagggcgtcccgctgtagggttgaaaatcgatagtaaagggtggcaattcctatgcatacgcattaacaaagaaagtgttgtctttggtcttcgtgatttaagtaataacttgagggttgaagaagagctaccgttctcattttcccttaatcaatcttttctggattgtatcgttgatgaaattgatgatttcttctttcggcatcaatcttgtcttgaacgcctgacggccattagtattaccaccaatgcgattatcgatcccaacaatgggattattcacagttcgccgtattatgatattcaagatatcccacttggcacatttttgcatcagcgtactgggttaccgacgtttctgcaacacagcatcacagcatggacaatcgcggaatctttatatggcgcgggggaaaactgtcagaacattatccagatcgtcattgacgataatgtaggagcaggggttatgacagcgggacagatgcttcatgccggaaaccatagcgttgtggaaataggacatactcaagtcgatcctgatggtgaacattgttattgtggtaatacaggttgtctggaaaccgttgtcggaataaaaaacatcttggtgaaagctcatcgcctggcagaaagccatcctgactcgttactttattcaatatcaccactgacaattgattcactttgtcaggctgcgaatcaaggcgatcttctggcaacaaacatcatccatgatgtcggagaacgaatcgggcgcatcatggcaattatggttaatatatttaacccagagaaaatcttgatcggttccccactgaacggcgcacagaacattctctatcctgccattcaacagcagatagcccaactgtctctccctggctatagccaacaggttaacattgttgccacccgatttgacaataccgggacactgccagcggcatcattgattaaacaatccctatatagtggtgagttgctgatcgaactcatgcaaggatagagcacatcaggcaaaacattgcgctaacgcaatccctatctcaaacacatctcctaaactttaagcttgctcgctataaagagtaaccggtctatctgtcattatggaaaaatgaatttatgttaacgcgcttatttgttacaggcacggataccaacatcggtaaaacagttgttacccgtgcattactgcaagtctttaatcgtgaaggaacaaccgcagtgggatataaacccatcgcgacagagaaacgagaaacaccggagggaatacgtaatcatgatgccttagtcatacataaatcttcaccggttcaagtcacttatgaagaaattaaccctattatttgggaaagcaattatgaagaagggaaccagattaactttgttcaaatgacaaaaagcctgaaaaatttaagccaaaaagccgatcgtgtgattatcgaaggtaatggtggctggcgtatcttgctacaagatgactcattctactcagactgggtggtgcaagaaaagctgcctgttattttagtggtagggattcaggcgggatgcgtcagtcatgccatcctgaccgctcaatccattatcaatgatggtgtaccactgattggctgggtagctaaccgcattaaccctgggctggcgcactatgccaaaacgctggataggttacggtatcatataccggcaccacaacttggcgaaattccttatcttttaaggcccgaagaaagagatttatcttgctatttggatatttcagcaatatccaagtttgataactaatcattagaaaaggggagctaaacgtgctccccagtttaattttaataagttctcatttttgagcttcttttgcatcgctagtagcgtgagaacctgtagtgtgggaaagacggatatagacaattttctgttttccataatcacagctaccgacaactttcccagtgccttctacaacttgatcattagggacaacttcaagcctgaaatcttctttagagacatgattatcaatgatcttttgagaaattatttctttcaggctttcacatgttgtcttttgtgaggcttgtactgcaaagggagcaagcgcaaaaaacaaggcaccagtcagtaggatctttttcaccatcatctccttatttattgatgtcgatgtttggtctatcagggtttgatcggaagacctgtattgagatccagacaacgttttgtattgggttcccaataagcattcacgttggtgcttttcaaacaggcatctcgattatcaacgtccacctcatacttatcaaactgtttttcttcacgtttgttaatttttttgcgaaggcttccctgttcattccattcttctttttgttgacgagccatttctttgctcatcgaattctcaccacccccattgatggttacgcaagtactactcgatgtacaaggcgcagaaaatgctggagtttgccacaataatggcaacaacagagcaatcacagaaacagtcttagctatcaaagaattatggacattcatatttaaacctctttcacaaaactatcaattgaagttaccccagaataatagtgtattttgaacacaacttgtatttggggtaaaaataacacttataaagttaacagttcatcaaaagacaattacggatttctatgcacacttaagcctgcaaatgactggcaaactggcatcatttccaatgtattgatattgacgcgagaaggcagagtcgcaacccaaaacacggcctctgcgatatcatcaggagtgagagcctcagcaccgtcgtaagttttgttgactttttcatcattacctttaaagcgtacttgagaaaactctgttccgccaacaagcccaggttcaatatctgtcactctaatattcttgccttgtaaatcagcccgtaatcctaagctgaactgcttaacaaatgctttagtcgcaccgtatacattaccgccggcatatggccagtttgctgccgtggaaccaatattgataacgtgcccatgattgatttgtaccatcttaggcagcagggcgcgtgtcatgttcaccaaccctttcgtattggtatcaatcattgtttcccaatcatctgggtttgcttgatgagcaggttctagccctaatgctaacccagcattattaactaacacatcaacatttcgaagtgcatcaggcagttcctgtacaactttctctattgcattacgatctctcacatcaagttgaatggggtggaagttttcgcctaattcggcttttaacctgtccaatcgttccttcctgcgccctgtagcaatgactacggaaccgtgtttaatgaatttccgtgcaatggcttcaccaaaaccggaagttacccctgtaacaaaaacaatcatagtcgtcctcttagttaccaattgttatcattaatttcatatcagtagaaaaagttctttatcattagtcaagaatgaattctttatccactattaacattgtgttttttaagtgttattttttactcattaatataagtgtcagattaacaatgacaaaaatcctgaaactctgcaactatagaggaatccctatcatgtcattgaaactaccgccagttagttgttacccgttttattgatgactctctactgatccgtgacaatatcggtgaacttactgaagaactcgtattcactcacggtgatcttggtgatagtaatatatttgtcgatagtcacgatgagctatatttcattgattttggtcgtggaggactcgctgaccagtggatggatattgctttcatccaccgtgacttacgtgaagaagtttcggacacagtggccactgattttattacttcactaaaacaacctgataatcccactaaacgggagtattacgaactgttagatgaactgttctaattaaactgtcagaccttcagataacctatcatcgtaagtatctcttacgataacagaaacttcgtatgggctaaaaaagagaagggcgaattatacaaaactgatggaatatttagtagcaacgaataaaaaatgaaaatgagtataaattcataagtgattactatgattccagaaaatagtggaaggtatcactgacgatgaaaataaatttagaaaaactttgttctccagccatctgggcagaaggccctgtttggctcccaagtgaaaatgccataattttcagtgacgtgaaaggaaataaaatgttccgctggtcagaaggagatgatgtcagtttatggcggcaaaattctaactatgtcaatgggaatgcgctggacaatgaagaaagggtggttagttgcgagcatggtaggcgggggatttctcggacagaaaaagatggcagcgtcatcatgctggttgacaaaatagatggcaaaagattcaattctcccaatgatgtcgttgtgcgttctgacggaacgatttggtttaccgatcctccttatggaattattagtgatgaggaggggtataaatcagaaagccagattattggatgctatgtatattgttacgatccaaatgataacaaaatctccatcgcaaccagtgatgttcagcgcccaaatgggctggcattttctccagatgaaaaatggttatacgttgcagacatgtctattgctgatttccctttgcatggaagacatgagcttcgtatctatccagtacaaggtaaaaccttaggagcaggcaaacattttgttactgtatctcctggatttccagatggcttttgtgttgataaattcggcaatatctattgcagttgtttagatggaattttaatttttaataaatttggcaagaaaatacataaaattgcagtgcctgaacgaacatccaattgtacttttggcggcattaatggtgaccagttgtatattacggcaacaacatcattatatcgagcctcgtttcgttggtaataaccaagataaccaagtaaacttaatacttgtacgactaaccgatttttaccagatcagcttcgccgtaaattttctgctgtcgctcatcatgtttttcttcgttaagtgaattaggatcccctaactacactgtcaaggctaagtagagatgtccgcctctaagcaaagttgaaatgtccacaaacatcctttatatatttaggatgtcgtgggttatttaacgctttctcttaatgcaggttgataaggagtaataatgtcaagagtaattactattgagccatataattcacattgggtgaatgcatataatgatgaaatggttaagcttaaagatgattttccggaggagatattatttgtgcatcatattggaagtacctcagtacttgggctagcagccaagccaattattgacattttattggaaataaaaaatatgggtaaattcgatgagaatcatagtgtgattgaaagtcttggatacaccgcgcgcggagagtatggcatacccggtaggcgctattttattaaaggcggggataaccgtacacatcatatccatgcttttgaaaccggttgttttcatatcactcgacatttagtgttcagagattaccttcgtagacacaatgatattgctcatcaatatgcagaaattaagtatcaggctgcaagagcatgtgggaatagctcagaaatctattgtcagctaaaaaacgaattcattctcttacatgaaaagctggctttaaaggaactatcccccaatgagaatcaatgaaagtgccacattatccttaagaaccacagccaaatattagagtagggaagaataacactgtttaatcggagttcttttcgaccatcaggatagtgccaaacatcaatgtattttccgattgctttacgactgatttcactatcttcaattaacatcaaaaccatgtcgaggaactttggcaaaacagcggttgtaatcatccatacaacattggttcgcacaatctatattatgttaaattaactaaaatagatcataacttcatgagatgaaccttttcagtcaattaactatgttctgccctgtttgatactgatacagaacgggaattgctggttttattcttgaattgaaactgtacataaacaattgctatgtgttgtctatttgaatgtcaatagattttgattgaacaagtttagtcttcgaagagtaataccttatccataacgcaataagtaccagaataataaaaaatactggtacagatagagtgagttccttaaaaataaacctgcccatatttatccccgatacctcccaggataaaaacaatgctacagggcatgtcaaaaaccctgaaataaacccaataacaatcaaatagtaaagttttcttttgttcgttttttgaatactgagatccaattttttctgataccgccagtacttcatggcgagatacaataatcctgacaatgagctgagatgctgtagaattttatatatacttatcccctgcccgttggtaatggaatgaaaaatgcggaactgtagtaaaggaattagctcgacaaaaaaacctttatcgtgtgtgaatgcatcccagccaatatgggttacagctcctataaataacgacaacacaaaaagaactctgtccttatagtctggttttttataacgcgcaaaggatattgggaaaaggacggataaaggatatgacaatagacgtacaatcaaaaatatcaatagacataaaggaaatgcggtataaaaccatccgggtaagtgatgcgcaaccgttgcaacatcatataacccaacagagtaaaagaaatcaggagacaaactgccagtaattagcgcaggcaaatttaacaacctcccccccggaagactcttcaaaggaaaaacggctgctggatgtgaaaatgtccatggcattacgaaaaatcctaaaaaaatgttaaagtctgcgatagggaatataccacagatgaataaagatagtttcctcctcattaaatgtacgagctcagacctgagttgatgactggatttgctgagatatgcgtaaaaacgatcattttagcggaattgttgcctttgtggcgacagcacaattaggcagttttactgctgcagctgaacgacttggactgacgaaatctgcggttggaaaaagtctaaatcgccttgaagaacgattggggcttaagctttttcaacgttctacaagaagtttgagtttaacccctgaaggtgatgtttttctgcaaagttgccaaaatgcgatagcgattttagaacaagccgaagcggggatagcttctcatattacttcaccaataggtcgattacgtattgatctccctgctgcttttggacgccaacgcattcttcctatcttgttaaatatcactaaggaataccctgaactcacgttatcagtctcttttagcgagcgatttgttgatgtgattgaggacggtatcgatttagtgatccgtattggtgaattagcagatagtagtggtttggttgctagacgcctcacaactcaaaaattagtaatttgcgctgctccagactatttacaacgtcgaggaatacctacaagttctgatgagctaaaccaacaccattgtgttgtcggatttcggcgtcatcagcccttccattggtgtttaagaacaacgaatggtaacaacaaaaatatcacgcctccacctacatacgaattggcggatggtgatgcaatgcttactgcggtgttagcgggttgcggattggcacagttgccattatggatggtgaatcgatacctaaaaaatggtgaactaaaaactgttttacctgaatattcgggggttgaagtaccaattagcgccctctggccaaaaagccgtcaactgttgccgaagatacgttatgttgtcgatactcttgttgcagcagcagaaaacggtttattggatgaataacaatgaattgttaaataatcgttttatctgaggtctgtttggctaccgttgcgcgattttttatgtaaatactaaagaaagaaagtattaaaaacagaattcccgtcagtacaatcgaatgtacgccatagtgtgatataacaaatccaccagccattgcgcctagggttattcctaaattagaaaaagcgatatataggctgttggcaaactcaggcgcttcacttgcttcatgcattaaccatgtttgactgacgattaaccctgatgaatgaaagataccccaaaatataattaatagcaccattacaaaaggtgaaaaacccaatatccacactaagcaatagaccagaataaataaaaatgtataagcataagtggttctaactgtatttttttgtaatagacggctaaagataaaattacccatataaccactagcaccaaataaaataagaaaaatggcaatcatattattactgagatgcgttattttggtaagataatcagaaatatagctaaaactagaaaacatagctgaaaaaatcaaagtaacagttgcaatgcttaaccataaatttggttttttcaatatagttacttgttcaagtatattgattttttggctaacaggtaatgacggaataaaataaaaaacacctataaatgcaattaaacatgtcacagaaccaaaataaaaggccgcactgagtgaaacatattcagcaataaaagaacttaaaggcattcctagtaccatcccaagtgcaaccccggaaaacacagtcgctactgcatcagcactcttctctttaggtactgaatttgctgctataaccagcgctactgcaaaaaatagggcatgagttaatgcaggtaagatccgaaaaatcagtattatattaaatatattttccgtagcataaataatatttgatacaatgaatataaatagaatgcataataaaacatactttctattatatttaaataatagtaaagtaataacaggtccggcaatagcaacgacaatcgcatatacactcaccaaataaccaacttgaattggagttgtatttaactgaagctctaattgcggaagtaaccctataacagaaacttccgttgtaataactccaaaaacagaaatcgttaaagtcattaataagaaaaatgatttatttgtcatgatcgtatccgcacgatagaaaaactgtcgtgattaatgagatgttatctacaataagatcagtactaataaagaattaaaaataatgtcttatgcagtaagagagttcgcagatgatgacaaaattgatttcaaaagagaagcctatttttgtctactgtttgtagaaaaaaagttgtcagttagcccagttatcgttccgatattcgggctaactttcatttgaattactgccagtctacaaacacgagtacatttcaacaatgtatctcactttttccaactctgtccgcagaggtgtcagttctatcgacccgagagccagacgaatcatatgaggtacgagcacagactgacgaagagtacagcgagtgggtggtttaacggttttattggtgtattaatcttcagcggttcattaccggcaacaaaagtagcagtcatggattttgaacccttttttctgactgtagcccgtgcttctattgctggtttgttagcattcgttatgctattagcctttaaagagaaacgctctggtttacttggtgaacctgtaagcctgatcatggttgcttgtaaccattgaagtcattctttgtgtcgttggctcacgtagatttcaaaatagatatcatttcctttataaacctaaccttaatctaggagtaccgtttatgttttcaggcctcagtgcatttcccttgacccccacgaacgaaaatggcatcgacgaagcggctttcgtccggctaatcgaacgtttagttgttgctaatgtcgattccattggagccctcggttcgactggtaactatgcttatttcacacttgctgaacgtttacgagtcacacagctggcggtgcaacatgccgggaacactccggtgattattggaatcggcgctttgcgtacacgggatgtattggacttagccgaaggtgcacagacagcaggagcgagcgcagtgctgttggctccgatatcgtaccaaaggctatctgctgatgaagtatttggtctgtatgaaaccgtaacccgcaacctttccgtaccgctggcgtatatgacaacccaaatatgacacatttcgaattcagcgacgaattgcatggtaggatcgctcatcttccgaacgtttgctccatcaagattcccagtgttacggtagatcccgtagccgcaaaagcgcgtgtggggcgtcttcgtgctctgattccatcacacgtgacgatcgggatcagcggtgatggttttgccgcgacggggttaaatgccggatgtgaagtctggtactcggtaatcgacggtctctttcctaaggcggcattggcaatcacccgcgctgcacaggccggagacatacaggaagttacacgcctatccgaacggctgcaaccgctgtggacatttttcagacagtatggcggcagcctgcgtgttgtcgcgtcggcagccgtgctactggggctggttgaacaagactgtctacctctgccgctcaaggcactggaggcggctgatttgcaacagctcgctgaactgcttgattagttagaattggcctgataaaccgcgttgctgtagctaatgatataacggcgacttcactggaattatccagcggagtcgttataagatgagtaattagctgtggatgttttgattcttttttctaatttgatcagaaaaaaccatgagatagtaattccctgctagctcatctgagcttttagctttcttgataaaaccgttgaattcgtagaaattaaccgctttatggtttttaactagacattttaaacttaattggtgtggatatttggatttgacgaaatccagtagttgagtgcctatgccagaccgatgagattcggtagaaacataaagatgatggataaaatgattctgtgcccaaacagagataaaacctagaaccttaccgttttctacggcaatataaatcacctcaccttcagtatctttatcaaaatcagtaagttgatagttatccgtattcagccaagtaaaagtgacctttctcgattccaagtaaagaattctcagtacctcaatatgttccgggcaaaacacggttatttccatcagttatagcacctcaattacctcaaactcgataacaacaacttccatatctggagaaaacgttccttctcgctcaaaaaaacacttatgctccatccgccaacgatgtagacttctatcaccctcgccttccttccaagccagttcggttgtcattgctgaaaattgggttaaatgaacagcagttactctaacaacacaaaccggaagatttttaccatttaagacaatatactcattgccaatttcgatatcttcatcaacctgtttataagcatgatatgaacaactcgttgctgttttagtgccttcggcaactaatgcagaaagcttgtcatacatttcgattgagtcaccaaatacccaactttcagcagcaggatatttattttcaattacttccatgagttcatgaattttcatattatctattgagcattatgggttcgtgaataactcactttattaacatgacaatgctgctgttaaccatcacttctaaccaaatctatgatcttccccttattctaagtatagaaaaatatgagcggtgaaaaacaccgctcagtcaaggaatccatgacgcttatttcctttacttaatctggtgcagaatatcgccgactgcattgaaaacgcgatcaagatcgtctgttttagcattgaacatcgggccaaattgcagagtatcgccactaaatcgcacatagaacccggctttccataatgcaatacccgcttcgaaaggacggacagcttcgtccccatcgcgtggggcaatttgaattgcgcccaccagcccgcagttacgaatgtcaacgacattcggacagtggttaagcccatgtaatgcttgttcgaaatactgagctaattcagcagattgttggattagattttctttttccaacaattcgagtgttgctaagcccgcagcacaggcaacgggatgggctgaataggtgtaaccgtggctaaattcaatcatatgctcaggcagccgctgtgccataaatgcattatagatctcgctggatgccaccaccccgcccagaggaatagcaccgttggtaatttgtttggcaaaattgagaatatcgggtgtgacaccgaaataatcagcccctgtccaacgacccaaacgcccaaaacctgtaatcacttcgtcaaagatcaataaaatatcgtgctgggtacagatttcccgtaaacgttgtaagtagccttgtggtggaacaatggcgccggcagagccacaaacgggttccacaataacagcggcaatattacttgcatcatgtaactcaatcagtttcagcagttcatcggcaagttcagggccaccagcagttggcattcctttagtaaaggccatgccgggttgcaaggtatgtgacaagtgatccacatccataaactgaccaaacatcttacgattaccgccaataccgccgagacttgtaccggcgatattgacgccatgatagccacgtgcacgtccgataaatttagttttggcagatttccctttaatgcgccagtaagcacgtgccatttttactgctgtatcagcagtttccgaaccagaaccagtaaaaaacacatggtttaaatcaccaggcataagattagcaatcttgtctgccaatttgaatgaccaagggtgaccatattggaaaccaggggaataatccaatgttcccagttgttcagaaacagcctgacggatttcggttcgtgaatgacccgccccacaagtccataaccccgacaaactgtcgtaaattcgacgaccctggttatcgaccagccagtttccatctgcggagacaattaaacgtggatcttgttgaaaatgacgattggcactaagcggcatccaatgcgcattcaggttcagtgattgaaaagaattgatatctgacatttttaaactcctcatattaagttgtaacaaagagtttgcaatagaacaacattcaagttaaaccttaattatcgaatcattagttatgggtttacttacgtaaagccaaattttactgaataagaccgttaaccaccaaccaactcgtatccagttcacacaaccccattaacctccaaaaatgttttaacaaaaccggaagaaatacagtaagattggcgcctaatcgtgggaattgatctggatcattagcttgttatcgctttttcgtctatcacaacgccgaatacctgccttgatcgcctcactggcgattttgatgttgttcattggaccagtggtatcaaaaactctggagcatcggcgtgacagcataaaaagcgaagtctaccacaacatgccaatgtctggcatgcaaaatagcaataatcatcattacgcatcaccggcacatggtcatgacatgcatcatggcgcttcccatatccatacggggttgatggatgatattgcctgtggttattgtcagcttctgattaacctgccattgttgacgtgggtgtttgttccttttatctggctggcactgactatctcccgcaccccaccagtccggcttttttggggttctgccattcagctattttatggcgaatcgcaaccgcgcgccccaccccttaattaatctatttaattgaaataattcatttattttccttgctatacgctgtttgtaaggcaagtcaatattttttcaagcaaatttaaaaacaggatttgtttttaattaagggatatttttttatgtctactacacaattatttcgtgtatcacctctgacagccgctttagctgtcattctctttatgcctgccagtagcttggctgcaacaggtgaaaataacaacgacaaagagataaaagacacacagacagttaatgatagagaatcggtgataattgtgaccgctccggcgatttcaccactcactataattacctcacccaaaacacctcgtcagcctgtacccgctagcgatggttcggattacttgaaaactattcctggtttttcccaaattcgtaacggtggtactaatggtgacccagtatttcgtggcatgtttggctcgcgcctgcgtatgttggttgatgatggtgaaatattgggttcttgtccgtcacgtatggatgcaccaagctcctacatttcacctgaaagttatgatgttctgagtttggttaaagggcctcaaactgtactttggggtgcaggaaactcagcaggaacggttcgctttgaacgtacccgccctcagttcgacaaactgggtgctcaaggtaatatcagtacggtagcggcttccaatgggcgttgggatggtaatgctgacctcagttttggtaatgagctcggctatgtgcgtttgagcggcaataaatcacgctctaacgattataaagatggtgatggtaatcgcgtaccttctcgctgggataaatggaataccgacatcgcagtcggctggacgccggatgatgatactttgctagaattaacggctggccagggtgatggtaaagcacgttacgctggacgtagtatggatggctccaagttcaaacgagaaagttttggtgtgcgttttgaaaagtccaacatcagtgacgtgttcgacaagtttgaaaccaatttttattacaattacaccaaccatattatggacaactattccctccgtaccccttccccaatgagtatgggaggacatggtggacatggaatgggtgccatggaactggatcgccgtactatgggcggccgtatgatggggacttggatttgggaagattttaagttacagagcggtgtagatactcagtccaatacccatcgaaacaaatatgacactgtttgggtgaaagatgctcgctaccgtaattatggtattttcagtgagttaacttgggacgccactgaacagagtaaagttatcggtggtgctcgtctggatagagtactcgtggataattacgttaaggcagcagaacggacagctactctaccttctggcttcattcggctcgaacataatctgacggaagtaccgttgatgttttatgctggtgtgggctacaccgaacgttttcctgattactgggaactgtttgattattgggaactgatctcgtccaaaccagagagtaaagccttcagagatttgaaaaccgagaaaaccactcagttggatattggtgcgcaatatcacggccaatattttagtggttgggtatctgcttacgtaggtaaggttaatgactttatcctgttccgctattccccaactgataggacaaaaagtcaggcgaataatgtcgatgccactattatgggtggagaaatgggcgccagctatcagttgagcgaccattggaaaaccgatgcaagtctggcttattcttgggcgaagaatacttccgatcatcgcccattgccacaaactccaccattagaagcgcgatttggactgacttgggaacatggcgactggacaagtagtggtttgcttcgtgttgttagcagtcaaaaccgagtgtcaatcaatgaaggtaacgttgttggtaaggattttgatcgcagcgctggatttgctatcctgtctgcaaacaccgcctataaagtgactaaaaatgttcaggttagcgccggtattgacaatatttttgacagaacctacagcgagcaccttaacttagccggaagtaatagttttggttattcaagcaatacgccagtaaacgagccgggccgtacttattgggctagagtgaacgttaaattctaaacctacttttcgccctgactaatgtgtcagggcgaattttccgtcttgattaagtgtctttcattaaagatatgttttattgaatctatttttatatctttaaaataagatacttttgcctctctttatttctcgaaaacatttcaagtagcagattcattggtgagcagccaatggcgtaacagtatggcaatttgttcctgttgttcttccgtcaatggctggagaatagctctttcgttctccaaatggctctcgacagcattgtctataagtgtttttccttccggagtcagaaaaactttgcagctacgtcggtcttcttcattggcgatacgctcaattaaccctcgctgtaccatatgctcaatacgggtactcattgcaccagaagtcagcataactgactgatacatttcggttggtgtaattggtgtgttataacggcgaagtgtagcgagaatatcaaactcaatagcactcaggccatgtgctttaaaggcatgttgcagacgctgctcaatgattttgtttacacggactaaccttccaattacccccatcggggaaggatcgaggtctggacgctgctgttcccactgtattagcaaacggtcaacgtgatcgtacttcattcttttttcctattcatttatttcaacaaaaagatacttgataaaaatcgtttaggctattattttaatttatctttaaataaagatactttatattgagttaaaaccctcagaaaaggaaatcattatgcaggaaacgagaatactcagtaatattttgcttaccgcactagcgcctatcgtatggggcagtacctatattgtcgccactgaaatattgccgcccaacatgcctttattggcatctaccgtcagggctttgcctgctggcatattattattgttggtttgccgcacagtaccaaaaggagtgtggtggctacgtctcaccgtgctggggctacttaacattggtgcttttttctatttcctttttgttgcagcggggtatcttcccggaggtacggcgtcgctaatcatgtcttgtcaacccgtgattgttatattcttaagtgcttatttgttaagaacatcgctgacaaaaaaacattttttttcggcgatgctgggtattgccgggattgcattactagtgatgaactcagctaccagcctgaattggcagggagttattgcaggatttgctggttgtagctgtatggcattgggggttgttctgaccaagtattggaatcgccctgccaatttatcattactgagttttacgggctggcaattaacactgggtggattgatgttactaccaatcgcaatttacactgaaggtgtgccacaacagctcacaccaactaatatcatcggctatggttatttgtgtctgattggtgctattttctcatatatcatttggtttcgtggcattgagaaacttcccgttgtaagcatctcattcttgggatttctgagtgcattatcagcctgcgttctgggatttgtttttctgaagcaaacattttccttgctacaatttttcggagcctgcaccatcattgtttctgtctggctttctattcctcggaatcagacacaaaaatccaataactctacaatctaataaaatagtaaaaaggatgaaaaaatcatcaatgaaacttaccattatctctggtagtcaacgtccagattcccgcagtcaacgtgttgcatcatacttgcaagaattaagtcgtgaatatggatttactgatatacatctgcttgaactgtctaatgtagaacttccatttcacgatggttacacaacggatatatcagcagaatcgcacccttggcaggctctagctccgaatctaagagagagtgacgcatttatttttattactccagaatggcacggtatggcaacgccggcactaaaaaatttcctgttgtattgctcagtgacagaattgggtcataaacctgcgctattggccagtgtctccgccagcatgaacggtgtttatcctcttagcgaattacgcatgacaggttttaagaacaatcacgtttgttttctgcctgatcatttaattttccgccacagtgaaggtctgatttcgacagatttggcttgtagtaatgctgaatttgaagcacgtgcgaaatacacgctgaaactattgaaggcttatgctgaagccttgaagcaagtacgcgaagtcgttggagaagaaagcaaaaattacccttatggcatgtaaaacagatagaaacaacaatctgcactgatggacaaacctcggctcaaccctctgagccgagaataagactgaattgaaaagctgctcgattaatccaatattttatatttatcccattcaaattcacgggcatgaggcgcaaaaaagccaataactgtataaaaacacagtataccgtatttttggcatttttgttcaaaatctagacttaattggatttaaaaatagccataaatatcaaaaagccagcatttaaatagatgctggcttttgctacccctcaacattcctcttactgagttatttggggtttgcttatttttgatgtaattttttcaacaaataaaatgtaataaaagcggccactacattgtagagcatgctgctgacgaaggcatttcggtatgtgataaaagagagcgcatccgcattattcaattgccattgaactaatacgctgacgactgcgactcccaaagctgcaccgatttgctgcaaagtagcaatgatacctgcggccataccagcaaatcgcacatgaataaaagccaaaacgatattgagtaaaggtgtcatcacaaaaccctgaccataccccagaagtatcaggattggcacgatcaataataaattggttgcaacggggagcgtagcaaccgtaacaatcagcgcaataaaagaaacagaataaagtaaagcgcccataacgatagcttgactaccaaaacgcttaacccagtaagacgcatttaatgaagataaaacaaaccctacgcttgctggcgcaaaaatgagtccagaatcaagcggagtaaaaccgagtccgttttgtaaaaataacgcaaatacgaggaaaaatgagctggcagtggaatacacaaacaagaccaataaacatcctaaactaaattgtttgttcttcaataaatcaaaatcgaataaaggtgtttttccttgagatacataatgaatctcatggcgtatgaactgtagcagtaccacacctgctaaaaggagtaatagccaacaccatataggccagccaaacacagggccgatcaataatggcagcagtaaggcgaaaatactaatactggaaagtaccaccccaacccaatctaattctgttttttttctcgctatgctttcattgatataaccagagcagacgaaagccaggattccaactggagcattgataaggaagatagagcgccattgtaaatcccatacattggcagaaactatccatccccctaaagtttgtccggcaattgctgcaaatcccaatgtcatacccaataatccaaatgctcggcggctattctctccttcaaaattgacgcgtatgctggcataaacttgtggaaataataaagctgcggcaagaccttgtaagaaacgtgcagcaattaaaaaattcgcggttggtgcaaaaccacagaataatgatgtcaaagtaaaagccaatatacctagttgaaataaccgccgtcttccaaagagatcgcctaagcgacctcccgtaatcagtaatagaccaaagccaatttcataggcaacaatgaccagcgtgatttgaaatatacttgcctgtaaatgtgtttggatattggtaatggcgatattgacaacgaatagatcaaaaatagtcacaaatccagccaataacagtactgacagagccaaataatcctttttagtcatgataaaaatcctctcggtatctgaaataagctgattttagtttccatatcgtcctgttacaatttaaccatttatactattactaaaagcaatgggttgaaataaatgacaaagttgaaaagaactcgcacagagttagccagttttttacgtattaaaagagaaagcttaaatcctgaatcggttggattaccacatattgggcggcgacgtacaccgggattaagacgtgaagaagttgcggctttagctggcgttggcctcacttggtacacatggctggaacaagggcgagaaattggagtatcggccatttttttggataatctggccaaggtcttaaagctgaatgcggctgaacgaaggcatttatatctactggctcatatgcgtgaacctgtcgaaaccggtcaaacgtggtgtgttgtttctcctataatcaaacggattatgaatgatttatctcctcatttaacttatgtattgaatctacactgggatgtattggcctttaatcaaccagcagatgaatattttcacttcagtcaggttaaagatgaacaacgcaattttttatggttactgttcactaatgattattatcgtgaattattgtgccattggaatcaggatgcctatcggttgttagccagtttcagacgtgattatgcccttgcagccgaagacggctatattcaaaatctcgttaataaactacttaaaacatcacccgacttttatgatatgtggcataagcatgaaatttatgaaccctgtaatggagtgcggcaactgaatgtaaatggggaagccatttcttttgaatatacgtcaatggttattgatttagaaaagcatctgcgtttaattgtttatgcagaaatctgagggggaaccccccccctcaactgggaaaaaacagcatccacagtgatatgtaaggtacagaattgccgaatgttctgagccgtattgtgaaataaattttttacaattgttttaaagttatttctataaataataaaattaatttttatttaaacttcattttgcttttttaaaacaaatatcgtgaaaggagaaatagtaaattgtgggagggttagagttgattgttggtaaagggaaaatcccatttcctccgaaagagttattaatttgctaaaagaccaaaaggtatcattaaaagtaaactgttccccagactttgtccgcatgctgacaggtagtgcctctccatcatggtaaattttaccctcttctcctgttttgaatgtcccgaaatctactcccatcgcattcaagttaaaattaagaaggatatagtaaccatgttcaataagagcattattgacttggcataacagtaacttaattaaattttcggtatttagagtacaaagcaaaaaagaacttatgacagcgtcgaacttactattattattaatataattaggtagttcgcttgcgtaaataaacgtagccccgctattcttatgcttttctcttgcattttctaaagcgtgttctgaaatatcggcgccaactacctgggaagcgatagatgtaagaaaaggaattaattcacctgaaccacagccgagatctaatactttttttattgagctatgttgtttaataaaattataaatagcagtaaatccatattgctcctcaaggatattatcgtactgtgaaaataatttaaatatatctttttctttccactgactcataaattcaccccaagtattattaatgagatacgtaattatcgcacctactactataaataaaattcaaaagtgtgactatgttatttttgtaacgaaactgttataaaaaagttaatagatttcttgcatttcggatttaattattatgctatagcgagtgtgggcgaaagatagatattgctggggatggccagcagcatcttagtcaaaatgatccttacagagagcaagagaaattggcaccgcctgctctataaatttatctcacctttcttataaagactttctgaggagcggtatgaaagacagcgaactgaaagtcactactttccgaaaaatggactcacttttatgaaaaaaaacaatccggcacggccgatttttttagggatgacattgttatttgggctattacctactggttcgttaattgctgccactgaatatcacgaacagggtaaaaaaggtatacctgatagttggttgtcagatgaatttaagaatcaatgggggttggcctctatcggtgcccattatgcctatgccagaggttatacgggtaagggcattaatgtcggtgtattagatgaggcggttaccaaccatcctgaatttgctgacaaactaaagataatcgctccatccgacatttggaactatagttatgattcctacagcgatctgatcagctttggcgcccatggcaatcatgtgtcaggaaccattgcggcgaacagagatggcaaagaaatgcacggagtagcatttgatgcaggtttaatcaccgcaaagtttctgcaaaatgattacaaccgcacagaagctatgattcaaagcgatgctcgcatcattaataacagttggggagttcgtccgcgttattatgtgggtagcgacggtagacctatccgattgcctaatgggactatcgcttattataaagttacattgaaacagctaattaattatgtctcgccaattaaagaaaaactaaacgagttaagccaagccccgctcgcagttacgggagagccgttagccagtgatgccggcatgttacgtgctgctcgccaaggaaaattaatggttttcgctgcgggtaacgcgaataattataacgtgacttggttacatgcagggatgccttatttcttcccggacgtactgaaaaactaccttagcgtcaccaatctaaaagaagatggtttgattgcaccctcgtcaactagctgtggatataccgctagttggtgcctagctgcaccaggcaccaaggtttacagtagcactggcgattttgtctcgaaaaatggtggcgaaattaacgaggacgctttaaagaaaggcgagctggagattgatcccacctatgatacttacacaggtacatcaatggccgcgccgcatgtggcaggagccgctgcagtcctgatgcaacgtttcccttatatgactgcggcgcaaattgccgatgttatcaaaaccaccgcgactgatttggggacgccgggtcttgatgacttatatggttggggaaaactgaacctgaaagatgccattaatggccctaaaatgttcattactaagcaagatatccccgctaaatattacattgaaggttcgtataccgaaacacagtttatcgccaatattgacggcatcggcagtctgattgagccaggcaccaccgtacaacgagtatgtaacagtattgagtgcgtctacgactattggagcaatgatatcagtggtcatggtggcctgactaaaactggcagcggtgcgctcttacttaccggagccagtacttattctggtccaacatgggtgaataaagggctgttattggtgaacggttcgataacctccgatgtgacagtacaaagcgatgcaaccttgagcggaaaaggcactgttggctcactcactgcttacaacggagctaacattgcaccgggtaatactaatactgacgctgctctgaatgttgatcgcgaagtcatttttaaaacaggctctcgctatcaggtgacattaacgccggatggtaagaatgatcgtatcctgagtaatggtatggcagggctggaaggtggtgaagtgcaagtgactttggaaaaccggggtaacttgctgtcgcagcaaaaggtacgcagtctgcttggccagcaatacaatatcttgcaagcgagcaatggcatctatggtcaatttgacacagtatcacaggggcatctgttccttgatatcccgctcaactatcaatttgatcgagcgttgctggatataaaacgcaacacaaccgagtttgccagcctggccacaacggctaatgggcgttcagttgccaaagcagctgatatgctgaattcagaccatccagttcatgaaagtattctaatggtaaattcagctgcacaggccagtcaggcattcagccaactttcaggacaggttcatgctgatattgctgctgcacagatcaatagcagccgctatctgcgcgatacactgaatacccgtttgcgtcaggccaatggcgtagccacttctcaggaaatcaaagcggatacagatggtgcttgggtacagataatgggtaactggcagcgtgccagcggcaacaatgaagtcagcggttatcggatgtccaactacggcgtgttgttgggtgtagataaagacttgtccagcgactggcggcttggcgtggctaccggctacactcgctcttctctgcatgggggcgatagtgcgtcagcacgcagtgataactatcacttggctttatacggcagcaaacagattgatgctctggcattacgtgctggtgtggcctacagttggcatcgttttgacaccgagcgctcagttgcttttggtgatcagtccgacgatctgaaagctaaatacggtgcacgtactggacaattatttaccgaagcgggttacggtattaaaacctcttggctgaatttggagccatttgccaacttagctcacgttaacttccacaacaatagcattaatgaacaaggcggagccgctgcactgcacggtgacaaaaaatcacaaaatgctaccttctctacactgggtttgcgtgccgaccaaaaatggaaaatcgaacgcgaatcccaaagagaattgcatgtgggtgtatatggtgaactgggctggcaacatcggtttggtaacatcaatcgtggcactaagttaggtttcagcaatagtaatacgatgtttactgtcaacagtgtttcagcggggcgtgatgcagcagtggttaaagtaggtactgaattagatatcggcaaaaataccacactggcactgggatataatggcgttttatcaagcagccataaagataatggtgtgttcttgaatgctaattggcgattctgatcagtaaaaattgcctgagtatattctcaataaaaaaactcactgctggcaagctagcagtgagttttttttcacctctgagtacaatcaatatgaaatcgtgggtataaatgttaaagatgactctaaaggtacaattgactatgacgataccgtacctcaattaaattaataattttttattaacacgcatatttaatcaaaaaaatagagaaatacctgagcgaataaaacaagctattccgctttcattatattaataaagaaataatgccttacgaaaaggagcgcggtgatttacctcggttgcaaacaattctcttctttccagccatataaccattccaaagctttgtaataatcttgctgggtcttacctttccacagtaaattgcgaacttcgcgttcaaccccttttgcatgataaagacgtcccatttcccgagtagaccacacaatacgagcagtacgcggaatgcggacggcttggtacagtttaaacgcctcaatcgcattaccattacacgctttcaccgcttcccctaatgttacggcatcttctaacgccatacatgccccctgagccatatattgtgcgactggatgtgcagcatcacctaataaggtgactcgaccagtgccccatgactcaacaggttcacgatcggctgtcgcccagcgacgccatgatgttgtcttatctaacatttgccgaggccgtggatgaatagtgtcaaagtaggacatcacttcctctttactaccatcagttactccccactcctcttgctgccggctatggaaagtgactaccaaattatattgtgaccccccacgtagtgggtaatgcactaaatggcaatgcgggcctccccataaaatgggggcattaattcgtaaatcttccggcatatcttctcgttcaataaccgcacgatacacaacatgacctgtaacccttggtttatcattcaatgtagagtcacgaataatcgatttccctccatcacaaccaatcaatacatctgctttatagctattacctttctcatcaatgacttctacatcattttgagtgatattcacttccaccacttttgttgcggttcgataactcactaatgaattctttaaagcggcttgccaaaccgtgtcatggatatcagctcgatgaataaccgcatatggaccgccaaaatagtcacgaaacacttgcccggtatcaattcgtaccacttcattagcatccatcgcatccatcatggcaatgtaatccgtaaataccgctcgctcacgcgcaatttcgccaatccccaaactatctaaagcagaaaaggcattagggccaagttggatccccgcaccgatttcacctatctcgttggcttgttccaataataaagccttaatgccgacttttgccagtgataatgcagcagcggcaccaccgatacctccccccacaatgatcgcactctgagttttgctcatcatccgctccatttttataatgatttatttatcgtaaacagccttatttattaaggtgctataagccctggctgattctctggtgctgccacaataaattcaggtaaggcactacagtgctggtaaaccttctggcaacgtggatagtgagacaattcacactccatccgtaacgcgttagcccattgagggatcaaaaaacaatccgccaatgtcacttgatcaccaacacaataatttccagaattattcttctctaacaaacgctccactgcgcctagccctactttgatccagtgggcataccaattttttttctggctatcgctaatctgcaactcatccgttaaatagcgtaaaactcgcatattattcacagggtggatatcgcaagcgataatagaggcaatctctaatacttgagtgcgtatttgtgcgccttgtggtaagagttgtggcacagggaaacaccgctctaaataatcaataatagccaatgactgacccattgagttgccttcatcatcaattagcgttggtacggcgccaacgggattaagctgcaaatattccgtatcatactgttcaccaaggcgaatattaactggctctgtttggtaatcaatacctttcaacgctaaagcgatacgtacccgataagaggctgaactattaaaaaaactaaatagtttcattctttcatctccttatgaatctaaatgatcgccacagttaaatctgttaatccttctacgccacagataattgtatcccctttcacgactgcaccgacgccttcaggtgttcctgtataaataagatcgcccggctgcagttcaaagaaggtcgatagataactaattgtctctgcaacagaccaaatcagaaaatcaatactgctactctgatattctgtgccgttgacatgtaaccatatcgccgccttattcatatctgggcagctcaccgatggatgaatcggtgaaataggcgcagaaagatcaaatgctttaccgatttcccacggacgccccattttacgcatctcgatctggcgatctctgcgtgtcatatcgagccccgttgcataaccataaacatggttcaaagcttcttcgacagagatatttttgccgcctttcccaatcgccgcgaccaactcaatttcatagtggtaattctcggtttgctcaggatacgctaattctaaaatctcacccgccttcacaggcacaaccgcatctgctggcttacagaagaaaaaaggcggttcacgctcaggatcaaaccccatttcacgagcgtgggccgcgtaattacgccctacacaataaacacgatgaacaggaaaaaattcatctgtcccaacaacaggaacggcaacttgaggtgccggtgaaaaaacaaacttactcataacaaatttccttaatcaaatatcaacgagttcctaatgtgaaagcgtctaccagagtggcgcagctatctttaaccacgagcttcccgaaatagacctaatacctcttgtactgggcgatccgaaaagctgaataacacggtatccgactgagtttcaaaactgacgggaagccaagatggcactacaaaaatatcttttggaccaaacataaagttctctcccccgatagtgacctgaccttgcccctcagcgacatggtaaatagtactgtctgtagaacgactgttttcccctttaaacccttttggtaataactgcaaaaatgctgccatggttggcattgtgtacccaccatttgctgggttgacataacgtagtttgaaccccttcatattnatctgaatcactattgcgggcttagctgttctaacgcttctcggctgcggtcatatcgataattaaaaatcggtgaagaattacctgattgataacgtacaggcagcatattggcggcatagcgtggcaagtagtcgtcatttggacgtaacacgggttgctgttcttctgggtaatcctccgcaaatccacatcccagatagttcactaaaggcaaatccaagccatcaagccagataacaggctctgttcctgggttaccatggtcatgccattgccactgcggagttagaataaagtcacccgcctccatcgtcgtccgctcaccattaacggctgtaaacgccccactcccttcaacgataaagcgtaaagccgattgagaatgtcgatggctcggtgcaacttctccaggcatgattaattgcaatccggcatataatgatgacgtaatagatgacttaccgattaacgcagggttttctaataccagtacgcggcgaatcgcttcgcgagccccaattaactccccgctttccatcaaaaaagggcgaatatcctgataacgccatagcgcggcagaaatagaggaatggggtacatctggcactaatctatgtaactcttcccaaagaggcgaaaggtttaatttcgcaatgtcctgatagaaactctttctgcgatctaattggcttgtgttaattttttgcatgtttgacccctttatatgatctatttttcttgtatggtcatgtgcgagacgacaatacgtgccgttctatgttgtgtacgtaaaataaccattgctaaagcagcaacgacagcaggtaaagcgataacaataaatatcgtgctaaaagagatattccaagacagcatcaaaccaccactgagggatccaacaatcgcaccacaacggccaacggcgtttgcccagctcacgcctgttgcacgacattgagtaggatagagtgcggcggacaacgcattaaggcctacctgagagccactaatccccacacctgtacccaagacaaccagtgccatcatccataaagagccttctgagaagctgattaatacaatgaatactgcccctagggcgtaacttaccgctaatgtccaataaggatttaagcgatccatcacaacccctatcaaaatagcccctgccgttccacccacctgaaaggctgtcgtcacccaagatgcatgttgtaaatcgatcccactattgttcagtaatgtcggtaaccaacttgaaagtgagtaaataatcagcaagctcataaagaacacacaccataacaacagtgttgtaggtaagatttcacggctaaataatgcggagacagcgcttttttctgcaggtttttcgtccaagtaaaaagtgacatcgtcataatttttacccgtaattttattcaagacatcaggaattttttcgggttgatactgttttaatactcgataacgaggtgattcaggcaagattttccatagcaagacactcaatgctagtggcatgacgccaccgaggatcaagatcccttcccagccaatggaaggtacccattgagcacttacaatcccccctagggctgaacctaacgtaaaaccacaaaacataagcgtgactaaaccagctcgccgccttgcaggcatgaattccgatgttaatgtgattgcattcggcattgcaccaccaagacctagccccgtcaaaaagcgtaatatcgttagtgttgtcatatctgtagcaaatgccgataacaaacacattaggccaaaaagtgccacactgaattgcataatatttttacgaccaaaacggtccgccattggcccaaatatcaaagcacctaacgtcagcccaaaaagacctgaggcaaacaaaggtgctagatgcgctgcatccaactgccattgttggcgaatagcgggagcaataaacccgattgacgcagtatcaaaaccgtcaaacgttacgactagaaaacaacaaatcaacacttgccattggtagcgggatacaggggctgcatcaatcacctcctgaacagtcatactgcgctttagtgccatttcataacctcatgattatcggtatttttatcatttttttaatacttgttgctattttgttaagagagtattactactagatttgaaaatataatggtatttcagcctcatccataacctgggagttatacctatgagtaactggacacaaaaattaaaaattcagcatctaaggctgctaatctgtattggcgagcaagggaatttaagtaaagttgcagagattatggggattactcagcccgcactatcaaaatggttagggggattagaggaagatattgggatcacactctttgaacggcacagtaaaggattgcgtccatcggaaggtggccgtctgctgctggaacatgcccagcgtatacttaatgatttagaacggtctcaagaagatattgaacaatttaaaatgggtatcaaaggtagtctgattattggcagttcacctgtcgccacggactgtgtttctcttgccctcctttcacttgttaatgattacccaagtattcatgtcaaagtcgttgaaaatgtcatgacttcactattgcaaagcctaatttccggcaaaattgatgttgtggttggccgagtcggtggaaaagcattgcaattacctctcaattatcaaacattatatacagagccggtctgttttgtgggtcgttgtaatcacccattagccaatcgagagagtattaattggcaagatctcttagaatacaactggattgtctggccaacaggtactcccattcgtactagcattgataatgccatcgtcgatcaaggtgtaatgttacccaacaattatctagaatcgtcatcaatgaatgtaaccattaatatgatccaagcaagcgatattgtctcgattttatcgtggcgtttagcacatcgttatgtagaaaaaggtcaactagcaatattgcctttgccccgtatcgagcaaaaaggcagcgttggggtattttggcgtaaagatactaccccatctgatgcattgcagtgcttcttatcgcatttaacgaagacatcggcagaatcagaaaatgatggagtttttgtgatatcaaattagaaatatgggtatcagacgcgatttcttggcagttgtgttcttttgcccagagacacgcatgggatatcagcatatttgcgattcctttctggcgatggcttgaggtcgtataaattccttcaagaaaggcgacgggtgatgtttcacaaccattaacgtaatcaaatcttaaagatagttcgattaaactaacatattctccttctcttactttaaacataaaagcagcgtgatgttgtgattcgataatttcagagatttctttaagatgttttgtctccgaactttctggccatagtgcctttcgtaaattcaactaatcaattagatttttgtgtgtgcatttgacaatgttttgcatttttacttaaccttatatcttcctaacaataaaaatcatttcttccgttagctcgtgatatccatcccctgcccagctatctaatgtggtaactatcacatttatttcaccaaggctagatattttatccctattttaataaaaggaggccagaatatgccgccacgttttattctgcctgtattggcactcactgtattttttattggtacgacggaatttatgctgtctcccatgctcaagccattggccagtgcatttagaacgacgcttgataatgttgcttggcttgtatccggttatgctctttcctatgctcttgcagccccctttttcggttggctttctgatcgtgtaaatcgacgcagattgttactgatatccctgctgtttcttatggttgatggattggcgctaacatttgccccaaatttgagtactgctattggattgcgtatttttggtggcatcgcttcagcggcattaatcccaacaacgtttgccttgattgcagagcttttcccacgccaaaagcaagtgtcagccatgggtctggttatgcttggcatgacagcgggtattgctggtggcccaatatttgcgggggttttaacggaattatttgattggcgggcgccatttctggtcaatgctgcggggtgtttgctggtttttgtcttaggcaggaaatgtattccaattcaagcgcctgttgagagaataaaacaccagatggttacatttaaatcaatgtttcagtgggtgcgccagaaaaatttaatgattcctcttattgcaaaaggattttggaatggtacggcggtgtctgctttgatattggccggagaggtgttacgacaacactatgagataggaacaggaacgattggtatctcaatttctacattcggaatcggtcttggtttgggcaatttgtccgtcggcatggtgaaacgtctgggattaagggatgaactcatattgttactggcgatcgtgttactttcctcagcgacgactgcgtttatgctgatgcctttatctctgccctttagcctgagctgtttgattgtatggggaagcgcccttggccttgctgcaccgatcagtactgttattctggcaaatcgagcgaaacagcataaaggtcaggtactggcggtttcagaaagcttgaacaatctggtgattttgcttttgatcccaattgctacaatgctgatgactcatcatggcattgcagtaaccatgctaatgttaggattcagtttaataataagtattgtgctgacaataagagacttttttggtgacactgtcacgtaataaaaaagacttggaagcgctatcctccaagccttgtcaatcaatatatgttctgcatataaaactataattaaaaatttattccggtttgtaaaaataaataaccgctcacaccaatgtcagttatttttgtcaataatgagaaacgactcctcacgattcaacatctggcgtaattttttctcttcttcatcaaccagttgagttaattttctgacgaaaatagcttgtaattgattccaatgctcttcgaagtgttcttcattacgtaagcaatgtgtcattactgctgcacgtagtacataaacacagcgtgttttttcccactcactacggctaaaaccacatttttcagcgtagtaccaaggtgtatcaccgtactctttgtaatccagtatggttgaggatgtgagaaaatcgttgctatatgcacgtcctgaagaatatgaacacagttcataaattcgcttgttaagtgcattgtggttgataaggctggcgtttccgacttctttgaaggtgaagttgatcatgtgaaaatcaggtgttggcataatatgcattttaaaccgatactcaccgacttcgattggtggcatatttgccattttatctaatagctgattcgcggtgactatgccagcggctattacttttccataaccactgatgtttaaaggcagtaatcgatgagctgcccacagcgctgctgcggttgcccctgatttcgaaccttccatgatcgaagcgccaagtacccctcggttactggcaggagagttactttggttgtcattttcttcaaagacataaagggcgcgtgaagaaatcaaatcgagaatacgtttgtctttcatacaaattgccccggctgaatattgaataaatccaaccttatgcgggtcaactgtgatcgaatcgacatatcgcaatgctttgaagctctggtaaacctctggttttggccaactgatattttcaggtacgatgcctagtgtatggtgatagttaaccagatcatcatattccataaattccccctgttcattgagaagcatggaacaggcatatcctgcataagcggcatcaacatggatatagaatgatccaccataacgttcttcacattcttgccgtaatgcaatcacttcatcaatccgatcaatagcaccgacttcagtcgtaccgactacaccaatcatcgccaaaataggctcgcccttctcgattaagtcaaaagtgatttcccgcattttgccaatatcggtttgatagtgttcattcacaggcaatgggataatattttcctgaccgatcccaaaaatatctgctgctttcatccaggaataatgtttggattgtggtacgagtagcttacccaaaatttcagtcttactccctgtaccacgacacgtcatgttacgtatttcatcgaaaatcccacgttcttgtaactcgctgattaaatcgagaacttcagttgttggcatattcatcaattgctttggtgacttatgactaaccaactcttttgtatcaggatgttgggatacagcaaaaggcaatgtttttaagtttctggcaacccacaaaccttcatagttagcaacagttccaccggaagtgatatgtccccatgcgtgctgagggtcataaccaaacatccggcagagatctagcccggattcaagttcaagttctgttgttgtgggtgatgattcgtagctacagttgttggggttgtacatcattgccatcacataggcgagattggaaaccatcaaagtgtcgccactaatgtgacctagataacgaggggagaagaaaggaatcgaggtgtttttcaattttgctgatagctgattcaatattccttctgtccgatagagagtttctctgtaattatgctcataacgatcaacggatgtaaccaaagcggcatcttctgggtgaaatcctgaacgccagtgcatgtgttcactaactgcatagtccatcatttctctgaaaaaaactgcattttctgattttgggcctagaaacaacgcatctacatttaagttggtataaagaggcttagtcataatcacgataccttttgctggttcttagtgttttatactatttttcaatttatgcgtttataaatttgttaatgttataatttttgtttcatacgttaatggcacacctcttgtaacaaaagaaaaaataacaataacttattgaaattaaataatttaatttttgatgaatgtgctaaaaacattcattaacacatatcaaattaatctattttaatcgatataaaacatactttttaaaatattaatcataagttaataaatagtttcaaatttgtgcgctacaacaaataaatgtgcggaatacggagtgatatgaatatggaaatgtttcattttaagactatgaatgtgagaacgttctacataacaaaaaacatgacactgtcactaatcgtgttatgtagaacggcagaacaggggaagtggaaagttacccaatcaaggtaaaatggcggttacatgttacatataatgaaaaaagtatattgattgaccatctcagcgataaacatgataaccgtgccagacagaatgggaaaacccagacggattaacgcccgatttctccctttccataaggagtaagcccatattgccattgcaataatatataaacaccatgaaactattctcagcccaaatgcacttttgaaattaagttctggatggagtggaaagataatattttcgtcgactgttgtggtttctattaaccactccatataggcaggctgctcaatcaatcgcattgttacactgatgaaaacaataatcagcgctgccagcacactgctgaccaacaagaatcaatacatcatattattaattcaatttaagtttgattgatatgttatattgaatggtaaaaattttacgcaaattcggcgttaaccccaaaaaaattcttttttttctcaagatgcctttttgcgtgatgatttatacagtgattaataagataatctagctcttatcagagcgttctaaatatgttaaattgacgtatatcaatcacttctaatgagcactccctatgatcccggaaaaacgtattattcgtcggattcaatctggtggttgtgcaatccactgtcaggattgcagcattagccagctatgcattcctttcaccttaaatgaacatgaactcgatcagcttgataatattattgagcgtaaaaaacctatccagaaaggacaaactttgtttaaggctggtgatgcattgaaatcactctatgctatccgttctgggactatcaaaagttatacgattacagaagaaggcgatgagcagattactggttttcaccttgccggcgatttagtagggtttgatgctatcatcaatactgagcaccccagctttgcccaagcactggaaacttccatggtgtgtgaaatcccatttgaaacactggatgatctttccggtaagatgccaaatctccgccagcagatgatgcgcttgatgagcggtgaaatcaaaggcgatcaggaaatgatcctcctgctatccaagaagaatgcggaagaaaggctggcagcatttatctataacctgtcacgccgttttgcgcagcgcggtttttctcctcgcgagttccgtttgaccatgacgcgtggcgatattggtaattatcttggtttgactgttgagacaattagccgcctgcttggccgtttccagaaaaatggcattttgggtgttaaaggtaagtacatcgcggtcgaaaatatggagaaactgacggaattggcaggaaaagcccctgtttgcgtgtcctaaagttatcttaaattttaagccggatcgctatattttgctgatctggctttcttttaccctgttatagttggtcatattggtttatcttcttacaaagatgtatccagcctctgcgaggaattcaatatggcaaactaccaaaacctcttagttgcaattgacccaaatcaggatgatcagccggcattaagacgtgcagtatatatcgtgcaacgtaatggtggccggattaaagcattcttacctatttatgacctctcatatgaaatgaccaccctgctttctccagaagaaagaaatgccatgcgtaaaggtgtcattggtcaaagaattgcttggataaaacagcaggcacactactatcttgaatcaggcatcgacattgaaatcaaggtagtttggcatggtcgtccttatgaagccattattcaggaagtcatcacaggaaagcatgatttattattgaaaatggcacatcagcattctttattggaatccatgatttttacgccgctggattggcatctattacgtaaatgcccttgccctgtctggatggttaaagatcaggtctggccagaaaaagactctgccgttgttgcggttaatttatcaaatgaagaatcttaccatactgcactaaatctaaaattggtgaaagaaacgcaagatctcgctaaccgaattgtaaaagaacctctgattcatcttgtcagcgcttatcctaccgcgcctttaaatattgcaatggaactgcccgattttgatcccaatgtatataaccaggcattacgtggtcagcatttggttgcaatgaaagagttgcggcaaaaattctatattgatgaacaacagactcatgttcacgaggggctacctgaaaaagtcattcctgaaatttgtgatgaattaaatacgggagtggttgttctgggcattcttgggcgaactgggttatccgctgcatttcttggtaatacggctgaacatgtcatcgataagcttaaatgtgacctgctggcaattaaaccggatggttttgtttgcccgattagtgtggatgaagagtaactgttcgtcttttgtacggtatatctaaaaatactcagaagttctattatccgattttctaaaagccagctccataaaggagctggcttatttctctctattatttatgctctataacacaaatagttaaatcatcatgcttactgttatttttgaatattaaattataatattcaggtaacttgctcggtttatcattttttctttttttagttcaactgcaatggaaaacagggatcataataattaaaaataaattaccctattcctctaattattttatcttccctgttaaaaattcagatttttggctgcattttttaaacgttcatcgcctcttcgatcatatttttgggttgtagtgatacttgaatgccccatcgcatctttcactgttacaatatcctccccattgtccaacatagctgatgcgaatgttctacgcagatcatgaggcgcaaatttttccagtccactctcaattctacgtgtctccaatatatgataaattgcctggtctgacaggcggttatctgttacatcatcatcacgacggatacgggtaaacaatggcccggcataatcaccccggatttcatctatccagcggttcaaacgttcccacgttccttccggcatataagataaacgttctttgtttccttttcccatgactctcaatgcttgctcacggcgaataacatttttcaaatccagcgagataatttctgaccgacggagtccgcaaccgacaagtacaccaatgatggcggcatcacgtaagccttttgtgctgaagtcattttcacaagtaaaaaataacgttttaatttcataacggtcaagcgctcttcctttcggcaaccgattccccctgacagaacgcacttgtttgatatgttgaaaactgtcggtatcgatttgcttcattgtccaagcttccagcgccacgccttttaacgcggcaaggtaggtattgatcgtcgctggggctttgccggaatcggagagcatttccatgatagcttgcacatgatggcgtcgtagtgcattccaagtacagtcctgtacattttgatacccaagcatttttgccacgatattaagaaacgatttcatagtctggcgacttcgctttgagccaagactgacaagatatgcaatagcgggattgttatgtatctgctggccagatgcagacaatgacatgatcatgccctgcttttgttgatcacgtgaaatgaccatcaatgattttgtgtcttcatcacttccatcgttaaattcatctaggttttggtggttcaaaatttcctccttgttgctgatttcaatgtcttccgttcaaacaagctcgaatcgaattgttacaaaacaagtgtgtccactccgttcagataatggaacttaccttattagctcgatttttgatcataatcatgattgcgctgtgtaaaaaatgggactcattacccacacaatcttattgtagaaaagctactttttcaaatgtatattttaataagtaggataggttttaagctcaggtgatattgtaattagttgtttaataaaaataaaattcacatacaagaacgaatagagacaagtatcaatttttgcaaacgcctttctcaaggtatcatttcagttcatgaacgttgcatacggaacgccttacagaccccatatgggatctgtaattagctaactcggaattaagaacgaatggtgtaacggatatgcagaatgatatcgttcaaactgagcaataagtttttctgtttgtcgtttatatcggggaaactcagggttaatgtacccgtgtcatccacaggaagtccttcaaatggcaggtacttggcatcattgaaatccatctggaattgaccactgtcgttcattccatgtgaaatcgcgatagccttgcaaccacgtggcattattgtgctgccgccataactcagtatggcacggacatcttggtatgggcctaaaaatgcaggcagcgtgacactgatttgttttatacgacgagttttccctaaaccttcagggtaatctgcggcaatatccagatccgacaatttgaggtttgcttgtagttgtgttccctccaccttcaaaccgttcagatctgtaccggcacttcccttacctgcatttaccaactcaatgatcttatcagtaaaggtgaaactgttatctgacaggccgatatacacctcagctaaagaaacagttctagtgacctccagtgcccgttcatctttttccaaatagtttttttccatctgtgccaaatttagcatcagggtttcacctgctaacaaaccagcataagttccatgccaggcaccgggcttaatgaagcgtacagccttatcgttcaattcatactggtaagtttgttcagccatcaaacacagggaaacagccaagtcataaaactgataataaatagccgccaatcgcccacgtagccagttatacaacgctgtattgctgaatttgttttgcaggcaggccagctgtgcctgagtttgtgcctgttgggtttccagatagtttttttgcaatactgccgcttcacgacgtatagccagagcagctaattgggcatcaatttgttttagctcagtttcggcattgttgcgctgaatttcccactcttgtcgacgacggcggtatatttcggattggctgattttatctgcggcaatacgtgtggctgatgaagaaatctcgataccgatagcggtagcattgaaaagtgccccaaaacgtgagccccccacggcaaaaccgtaaatattggggactaaatctgcggctgccgcagccatatgcagggccgtactgctggtgctcaatatcgatgaagagagatacagatccatcgcttgtttttcaccggagttaacatcttcgtcatacaatgtactgaagctgtcaaaacgagattgtgcactatgacggctttccttaagcgccacttcatcagcatcaatttcagcaatcatcttgtcctgcattttaatactctgcaaagctaattcactgccttgagtttgcagcaattctgccagtgcttctgcatcctgccgttcagtaatgttgagcagggtattgccaaactgtatcagttgggccactccccacttggcattttccagaataatcggaaaacggtacatcggcattactgcccgaggcaaatctcctccgccttgtgaggcggtgacggcagcactaagcagtacggacggatctgctggtgtcgcatagatgggtaatgacaacggctgaccatcaattgtcagattatgacgtaagttatataggcgttgtgctaacgtctgccagtaactttgcagttttttgtttatctgaggaaggaacaaagcggttaacgaatttgcagtacgtttcgccggcaaggccgcgcgttgacgcagttgccgcattttatgctgataatgatcacgaatggtttgactggcggcttcttccaaacggggttctgaccaatcgttatccaatgaaaaataaggttcatcgcccaataaggtgagtgcctgcacataccacattttggcttcgttcaaagtatcgcgttcaagctggcgataggcgctatctccgcgagcaattagcaaatcgagcgctttcataaaggtagtcactttataatgcatgggatcattctgggcaacggcgtctggatctaccgaatccagcggattggcgttccaggaaatatcttcctccaatggacggatattccagtaataatcctgtatatcgccctgaaccagatagccggctgggttccaaatatactgcaaccaacgtgtggcgccagtgaaattttgttcatgtagtaagcgctgagccaccagcatgggggtatagtagaacagttcccagaaatagagagcattggcaccgctgaaatccatgggctcggtgtttttattattgagtaccgtaactaatttgaacatgcctaactttgaattactgttaatgccaaactcattttgttctttgttcacatagataaaatgaggacctgaccaagggacatcgccgtggtttttgctggtacttaataaaatttctgcaataaacctctcatcaagtggcttttcatccaaaggaatgaataatgttacggataactctttatcctgtaacatgccagaataatagacccggggagtattatcaacgacgtgtttgagattgagtttaaaccagcgctcatcgccatgctccgctttattatatggtggtagcacgaagctggcgtagaaacctttacccaattgcagttccggcaagttttgcgtttccatactcaaaacattatcaatgccaatattggctctttcagctaattttctggaaaataaagtatttaatcgggttctataagggccaatctgcatatattgtgcgcctgatggcattttatgcagcgatataatattacttttatctttggattttagctttatatgaatcggcgattcagcaaccatgccattataaccgacctctggcttattaatagtaaactcacctataagaggaatatcatagccttcaacatccactgtgacttgattaaaatcatataccatagggttagattcaggtgaaggcttagaaattacatggtcgttagcatttaattctactaaaatatcattgccattttttaataaaaaaccaatatatttatctggaatttgttggatcataggtgaaacaaactctatatctgtagcaattaaatagaaatactgacatgggtcgttacgttcaaatcctacaaaaataatttccggttcattaatgtttaaaatatcatcaataaatgcttcgcatatagtatgccagactcctgcgctatctttccaattagataccatattaacttcgaggcttaattcagtaccgttactcatatgaattaaaattccaccagattctctggagatcttttcttcggttctaccatgcattaatactctaaaatattctggattttttaaatctatagtaataataaaatctatagtaataataaaatctaatgttccataatgtacgatttcgtcatcttttccaagtatctcatcatgcctatcataatcaaataaaagaacttcctcatcttctaccatcgatagtaggtatttaatctcatcattatatatacctccttttgaaaagctaatttccattgatggtttgaagcttaatttaatatgaccactggttgatgattcatatgatagatcaacaatattgcctgttaaactaataattttgtttttgtctgtcgttttatccttgtattcaactaagtagtctatggtaaattgattattaactttatagtccgttttggtatcaagttctgataatgtacttttaacaatggcatttaaatcattctccgtgagaatagaaaatgtcatatcaggattaatggttattcctttgtttgcaggaaggttattgcttgaataagcatctttcttttcataaaaataaacaattatcacttctttttcataatcataagaacaatatataccaacaattgaattgttattgattttatcggatacattgaaactaaaaggggaaatccaacttccatcataacgaatatgtgacaatttcaatatataatcgatgacatttagcgaaccatcttcattttttaattcttttttctctagccacagtaaatacaagcgagatttgcaaacaacaggtctaatattttcctgccatacattgattggggtttcaatctttttccattctccccaggcgttggcagaaaatttaccgtgttcgcacttttgatgttcgacattacgccaataatataattttggttctgtctgactatgaccaattaaataggttaatccctcattcacattgatattgtcatggtatccactaatgacctgtaaattagcgacatcttcaaatgcagtcagataatttttgaaaccgtcttcgacggtatcggtgtttaattggctttgggaaagctgttgtaacaggttattcatcatacccgtctgaccaatacgcatcgtgggatcgatatagttttccgggtaatagaccagttcagacactccggcccaagtgctgtaacgtcgattataggtttcccagtcgcagaagaactgacgggctttcacttgttttgatattttactttcaacattattcaacgcccgattgacatacagttgaatactggcaattgcctctgccacacgggtagttttcactttggcagaaacttggttgtcaatcagtagatagctgtataactcatcccggctctgaatctgttgaggtgcgccattattgatatagtaagcactgaccgctgtagccgttgcttcatccaacagcgcctgaaggtaattggattgttgattgttcagacctgcctgcaacaaaatactggctgcttgccagtcatcaaaagctggcagaggtgtttcaggttcaccggcatattttagttttatgagtgctgcaacgccatccggagtgatgcccagcgtggtggctacatccagccattgcagagttgcatccattgttttccaattggtaaaaatgctttctcccgaaccagcctgttgcaatgcctgagccatttcttgaacatcaaattttagagctatagccaactgctcggctgtgagtctccccatgtctaatgcagttaaaatttctgtggcatagcttccacaacgcattattacagtgtggaaacgagtcaacgcttgaagtgtgagaagatcgtgctgtagtaccgttgtttctaattgaaaccgctccggttttgtgaccaacagtgttaattcgctttcgcttagcccaatattgcgcacaatcagtgaaagttgccccagtacctgacaaaaggctaccattttttgggtttcgttctctgagcgatcatttttggtaacaaggatcatgaaattatcaaatgtcagcccttgaggttttatctgattaatccatagcaggatagcttccgctgtcttggctgaatccaattgaatgctggcagcaataagcggtgcagcagcacggataagttcgtcactaccgagtgaaggtgtcgatagtccatgacttagtgtcgtgatcaggttttcaatgtccggagtgaggatagtgctgtaattgtctgtggtcataagaaatacatcactgactgaccacttttgtgttgccagccactgtgtgcattgaaacagaaaactgattaattgggttaattctgtatcggagaaatcggcaattttcttgtctgcatatggggaaacggacaacagcatggagaattcattcaccgtcagattatgaatttctgccagtaggtggacgcgataaaggactgacaggttcttcattgaacaaataaatgccgaatttgttcccttgttgaccagtttccatagagtatacagctcggtatcattaactctgaaagcacgtttcattactcccaagtgaaaatggttttctgatgcaccaggggttaaatccagttcggtattatcggcagaaaactcttgtccattcagtaacggtgtattgaacagcgttgtgaactggctggcttgctgcttagtggggtattgactaatattagaattacacaataccagcgcatcacttacgttaatattatagtgttgcatataatattggacataaaacaacttacccagcacattgctatcaatggttaaatcatcattaatactttctaccacctgccagatatcttctggagctattcccatcgctttatacaaacgaatggctttgttcaatttcaatagaaatatatcgccggggaattccaccattttgaagaatgtgttggcattgatagctttccaaggatctggattaactcgccataaacgaagtgttatgccattgataacttgttctgtcgtcagtttgatgggaatgctgtaatgggtattagcaataggcacgaaatttgtatctcgatatacatattcgtcatctccattttgaagacgaaaatctatacagtcatgctctgttttttttatgctgaaattatatttgtactcatttccttttaccggaataagctctgcgtaatttaaacgtgaatcgtagtaatctttgcgggttcgcttaatcaaccttgcttttgccgtgttattgccatcatttaccaatgttattagttgatcattcttatactgttgattggtgtttttcttaccgaaggacaaatttacaaacaaactgagttcatcataagacagatcataatagcgagccagagcagcataattcttaaaaattagaatatcatctgtaccgaaattttccttcatcagttccgctgcattttcctctgtaatttcttccacaaggatttggtacagttcaggggatatattcgccttgatagccaataacgatgttgggtccattaatttcgccacatctgtattacggctaaatgcagagagatttttatcttgtaataaaatggcctgacgtgctgactcatacggcagatgatagggcgtcaggcctgtttgccgataagcagacagcatttccattacgccgttatagtcagttttttctaacgtttgaatattatgcagcagtaattcattggataaggacaacgtagaaagctcttcatccatattatcctgtgtcagtgccagagcagcgatatcgggtcgccgtttattcaaatgatattgagatgtttcaggatgaaggttttttgattctcgatacaactctgttaagtaagccgcgggtgaaaacatggaagcaaccgacccgggtttaacaaaacggtgagcacgtccataaaaccaattgttataactgctgttctgtgatgacggtgaaatatcaaggttggtggtattagccaattgtggattagcacgagacagaatgcgtaactctgcgagtttactctgtttggactcatgatgagcctgtttatacaaaagattagtttctctccatgtcaacgcttcactcgatctatgacgaaactcactgaaggacatagatataatgtcagccaatgataaagtatcaccactcttttctttatttattttatttaacaactcattaatcgtgttcatatagctccttaaattattgtccatctagcggccggaaattaaccagccgttaatgttaatagatgatcattatgtgataacagactagctatttgagcagagacgatctcactcaggcaaaactttcttgattcgatcggttaaaccatcccaatgctgtttccagggcatcattcatccaccctgcattcccgtctgcgggtaatgtttcctctatatttctaaacgcttcaaaatcgttagtgtcttttgttctcacatgtagaaatgtttttccatgggcataaatagcagtactggaattttcgactacagcagctggcgaaatatctatatccgctacagcctgaaccacacgggcagctatactacgaagaccaagcgttttagctaatttacgccctgctaatgcgccttctatcgccgctgttgcagcaacgtcacccactccctccagagtttcctgagactcagccacctgagagcccattgcagtcgcgcttgaggcaatacctaatcagcggaaactgtaccggaggcaattcctatctcagcgccagctacacttctgtattcatcagaccgcccctgttgttttaaaaccggatcattaacggctgttaccccatgagctacagtcgcactgccaccacttccaccggccataacattacctgtagccgtagacaaatgcgccctgaaaataggcgagcataaatcttagataaagagcgagaaataggcccagaaaaaaagcccacagccccggcaatagccccgcctgcggcaacagcaccaacggcaacaggtatcgcaagccccgctgttgacacaacccccgcaatggcaaccgcgacgccgacaccaatgcttacccccctgaatccacgaataatgtttctcttctgctgctctgtttttgctttactcagcgcataattaagcagttttttataggttttcttgtagacgaactttatggcaggccctacagtctttttgataatacctactgggctgatatcaaacgataaatcaaaatcaaacagtgatggcatagagagcgacggtcgagagaaactgggcaaagaaagtccattgttgaataatccaccgatcagcgtaatagcgttgctcatcaatgatgccccccgtcactatcggtaccattgacgggattattgtgcaccatactgaacatattcaatccatcaacaatgcctccgggatccgcactgagccaacgacctgcccacggcaaataatatcgcagaccataataataaagtccggttgaatccctttctttgcctgaatatcggtgaaacttataatctgcttcagtctggtttcgtactgtccagatggccgttccaccgtagggatagtattcctcctggctaataattttcccggcttcatccacttccatcacactgctgccggtgaaattactataggaataacgtaacgggtcgccttgaatggctgccggctggcctgatacccagtgaagcagcctgacatggcccactgttataatatgtaactcttcattcagcgtatttcccctgaacatcgttcttaattccagcccgggaagataaacggttcgcgattttcgctgggtattaccattcaggtatttactgactttaaccagtcgctggctgtcttcgttatagcgatacccttcttcatccatctcggtatcacggctgaccggattgacccgggataattcaccgcgccggttataggtcagtacatccgtcgtcatccgagtggtaaaactgtctccggacaatggcgcattccaatcattgggcgtgtttcccctgccagttagcgtccatatcatttggcaatagctgtcgggttattcttatcggacttcccagtaaagatatgccctggcatgcttcacgtcctgccgtatcgtagcgggatgcacaggctccaatcaggttataggccttttcttgctgactatttcctgaccagataaagcgttcaacaatactgggttcctgccctgacgcctgttcagaaatactcagcagtcgcccggccagatgatgcgcctcatataaatatcgccgttttacccccatcgcatcaatactgatcaccggccgcccggcaatatcatttaatgccgcggcaacgccgtcatcggctccttctgtccggagagccataccactcaggctttgtatactggctctgtcgggttttatgcggttgtcgtttttccataaatcatgttgacggggtgaaaagatccgcgccggaaaaccggcttgggtatactgactaaaagaaatacgttcatcggtcagatccagcgtatccggatgccggtaatattgaacagttctgacgtttaggccgcggttatccatgacaactacggacggggttcctgaatataatgtctgtgacattgatgactcctgaaaaatgtttcccgatatctcggtggctagtacatgtgctattggctcacttccgcggccgtgtcgttttcatcttcactgacaacaaaccagggagtcattaacgtccggcgcagataacccgccgcagtcaccacttgccagacacggcccagcgggtcataacagcttgtatcagcgaagagatcgcgacgtgcactatcatctttgacatatcgccagttattcagaaagtaaggcaggtatgtccgtacaggttggcctttgccgtcatattctgtcctcccggataccacccacctgaaatcagtgtgttcattgatgggtaatccggcttcatctgcgataatcgtaccgtcatcactcaaccgccatgcttgccctgcttcatgtctggctgcggtttgtagcgttcttccgaaaccatcactgaaagagaggctctggcggagttgttgttctggatcacggtcatatctgtccgttgaaatattcagcgtatggggtggaaggcaggaatttgagctaaaactcgcggcggaatttcggcgcagataacgtctcagggcgagccgacccatgcgattatcttcgggggatacgtttttaaattctgtcgtttctggtgttacccgcggcatccagctcaggggggcgtataccgccagcccggccacagggatcctgggtttcagctcaagggcttcatggataagagcaggcacaataaacggcgtcacttcatcttcgggttgggtgtatccctgcatcaccccttcttccagtccacaaaatcttacgctggtcactcttcccagcgcatcaaacgtggaagtagaaatattatcgttcgcatccgttaccctattggccacgttaaaacgataatcatattgggcatacgcaaccgatcccgtggcactctgctcccggatcaccgcgcagaaatgcgtatcccagccgataagatttttgccggtcatcagcgtctgacgttgcgccagtggccgataaaacccttctgctcccgcaaagtcggtgtaaccttgatgtcccacccagacattaaatcccccgttgtcctgtaaaggcaccggaacagactgccagcccgcgttttcaagctctttttcgcgctcatccggactcatgatcccctcaaaggtttttaacgaggccttattaaattcagcggtttcggtgtaagcaacccggggaggaaaatccggtttaccaccagcaccggtatagttcactgtcacatgacccagatagtcatcttctgtgttaggcagttgtccggcaccgggagtgccaaaaaccgtactgaacccttccagtgataatccgccgtcaggcacgacgttctgagataatacccgggtatcactgcgcgacaccgctggcagtcccaatagccataatgtttcgtcaatcacatgatgatattcgtagcgctgacgagtcaggcgcaataacatttgttggtcatcataactgctgtcaaacagcgtttccggcaaggtatccggatagggtgacactgcgggtttctggcgccggggataagcgatactcagaatatctgcgggaaagcccaatgcatcacttttcagaacaatctgctgactgcactgtggatcgactgcaatgcgctcatattgataacttcgcgattccagcattgatggccatgctgaaggcgcctctgccatcattcccgcaagcaggcggatctgaggacgtgactcgctgacagaatagggtgtccccgccagttctgtatcgtcatccccatatatttcactgcgtaacggcatccccttcagcgcccggctcaaccagtacatttcctcttcattaggggtgatggtgacctcactgcctgtgggggtgtcgtagcgggtaaaacggggtgtaaagcttgcaaaagcctgttcatccccttgccagtattcgcgcggcagccactttcattgatatagagctccagataagtactgcggacataaatcaggtcagtggtaccggagccgtccatatccgccatatacaatcgattggggttaaaagcttccccggtaattcgaaaacccggcagtgtcaacggttcaccgaagcgtccccgacccagatttggccaacagcgaacaccgtcagcagagacttccaccagatgcggctgcccggaacccgtcatatcactgaatgccaccaatttgcgcgcatcccgtcccgggatcggcagcggaatgctcccctgacagcccacatcctgagctttatcccatccccccggggtatctgcccagaaccgcacactatggggaccaatcagtgcaagatcgggtaaccccgagccagtgatatctgccaattgcgcttgcggatgaaagtattccaccgggatggaagacagcgggataaatggcgtccattccccctcaggcgtcatcgtgtggtaaccccggagtccggcggcggtcaccacccagtccagccgaccgtcgccattgaaatcgatcagcatggcactgtcctgctgagccggaatagatggcaacggttttgccgtatcataggtggccgcatctgcgttatctgatgccccgtctctcatgggtgcccgataccaccaggcgccgggtgcatcctggtaaaggatgccaggaattccttcaccgtataaatcgaccagttgataaggttggaatgcattaaatttttccaactcgggcatcttctgccagttcaggttcagttcattgtcaaaacgctgataatccacctccagcggagccagggtgaccggtgtgccctcggcctcatgcgccagatggcgtgcactgagtaacagggaaacacggttgttcaggtcataatccagaatcaggcgggacaccagtgccgggacttcgtttgtgacatttccccccgccagcgcctgcagacggtgaaacatcagaacctgctgacacagacggcgggtacgaacctcaaaaccaaactgataacgggaaaaacagtccggccggcacagtgtaaagggaagaggaacgttcaccatagccaaacaccagatgaaacaaccaggcgtcgtcagccggaataccggatttcaccgcaataaacgcggcttccggaaaaatattgccataacagacttgtgccagatagcgctgtgcatgcataccggggtgctgattgagctcactggaatcgcaaccggcatcatcttcggcacgatagtgataatagatatgctcgcccgtgggcgttaccgtttcttccagtaaccagcaggcaattttcgttgtctctttcggatcagcaatttgtgcgtggcggtgtttacccagcaaatgtacctgtccatcggtggaaaacattacccagaaaggtttatcctgaccgctctgttgtggctgccagtactccagtttgctgaaatcactgacaatgcgtggctgatagcgggtgacgatatgcggttgtttcagcgcagtgcccagtaatgaggtcgcagtgcgccgatctggctgcccttttaggtcaggaacaatcgacaaggcttccccagaagggccgaggaaaatatcctctcccatatattgaggcacaccttgagacgtacgcaggctgattgatcctagcccacactgccatcccatcccaaatgccccattaccggctgcactgctgtaacttaaccccagcgatggagcgactccccgcccgccagaaacgggcaacggcagtgataaagatgccagaccatccgggtcgaccgcccccagtgattcccccatcccatagagtgaaccaccccctttcggcaatgacggcatctccagtttcaggttttttgaactctgcatatgattctccctcggcaggctttatcaggagcctgccctcttagttttcggtgaacggttatcaggaacggatggtgtagcggatatgcagaataatgtcgttcaggctctgcaatatcgccttctgccggtcggtcgcatccgggaaactcagcgtcagactgccaccgtcattcaccggaatgccttcaaacggcaggtaacgggtatcgttgaaatccagcacaaattgcccgctgtcattcatcccgtgggatagggcaatggcgctgcaaccgcgtggcatcaccacgctgccgccatagttcagtaccgcccggatatcttcccccgcaggcaaagccgaacacgtttggcagcaggtcagccaccccttctgccgttgtgagcacctgcccggccagggattgacctgccgccgcatcaaatagcgacatggcccgctgttctccgtggttgatgtcctcgtcatacagctgctggtatttctccagacggttctgcgcactgcgccggctctctgccaatacggtaatatcggcatccacttcgtctactgtccgttgctgaatgcggatgctctgtgtcgccagctccatgccctgctgcagtaacagtgtggtgagttcatcggcatcatcatgctctgccatactgagcagagaagccccgaactgggtcaattgcgccaccagattgcgggcccgctccagcatgaccgggaagcgatatagcgccaaagtgcctgtcggcaatacactgccgccctgagacgcctgtaccatgctggtgagcagcgctttcggatcggtgggttcggcgtagatcgccagcgataacggctgcccgtcaatggaaaggttgttgcgcaggttaaacagacgcaggcgcagggttttccagtaatcagtgagcgccgggttatattccggcaggaacagcccgaccagagaattagcggtacggggctgggactgcgtggaaacgtctccacggtccagcgcagcaagatcctgttgataaaccgcctgcacagtctggctggctgcaacagaaagggacggtgccgcccactggctgctgccgtaatcctccggttcgtcaccgagcaattccagagtgcgcacataccacattttcgcttcattcagtgcatcacgggtcagttcgcgataggccatatcgccgcgcagaataagctgatccagcaggcgcataaaggtggccactttgtagtgcgtcgggtcactttgggcgacagcatccgggtcaattgcgtccagcggattggcatgccaggaggtggtctcttccaacggtcggcaattccaggtccagggagtgatttccccgtcaacgatatagcccgcgggattgtagacgtagttcatccatttggtggcgtcgtcgaattgtttttcctgtaacagacgctggaagcacatcatcggggtgtagtagaacagctcccagtaatagagtgcacaggcgccgttaaaatccagtggttcggtggtgataccgttatggggttgtaccccagcgaacatactgacattcgaactgtcatggatacctattttaccgctatcatccgtaaagtgtggtccgttccatgtaccgtcattgggattcttctgagtggttaaaaacaccttggcaacgtatgacctcaggggtttatcatccaggggaataaagagccgaaccgcaagctcggtatcctgcagcaaccccgaataaattatgtgcgcattatcatcaaccacatgtttaaggttaagctggaacgcccgactggtaccatgcgtcgccgggttgtaaggcgccagggtgaacgtggcgtagaagcctttacccaactgcggctccggcagctgctgcgtcgccatggtcaagatggtatcaatgccgatattcgctctggacaccagttgaggtgccagcagggtattaaggcgaatgcgataaactccaagctgcatatactgaacaccagcatcagtgttatataggtgaagaatattgttttgagagtaatctactttttttatcgtcagcgtaaaactcgcctttccaatactctttccatcgttatctttaatttcaaaatagacatctatggactctatattgttaataaaggttagatctgacgcattcaaaataacaggattaaatacgtaattcattccttcaaagctgggtttcggaaggttattggctgcatccttggcattaaagacttgattttttgtggattttcttacagaaaagaagatgttttttgcatctatgttcgaatcaaaataataccaccctttcgattgcgacataaacataggccagtagaggtaactccggagacgtaagacataaaaagtggtctcgcactttttaaatttttcttggcgatttgagccaacgtgaaagtttgttgtattctcaaaagagttaataggaaataaaaactctctggaactgcctgaattcaaggctatgtagttgtcttctcccccaagataaaaaggagagttttgtgcgactccaatggtattatttgttgtgttataaactggaattggcccgtacatctttggaaaaggaagatatttacttaccttatccgccaaaataaatgtgtgatctggcttgccacaaactttcattgcaattaattgatggcgtcttagatcatcatttgctcgataatttagagtaaatcccggattattcagcgtaataatcaagtcttcacttgaatggacgtgagatatttgcggtatcaatgcattatctatagcgataaatgaattttgactgggagcggagtccagtgctaaagagctaggaatatcataatcttgagcaaatttataattggcgcgtttaacaatatgccccctatccgaagagataatatcgaaagtattctttatcaaggaatagcgattcaactgcttcgcattcattgggttgcaggtgccatccgcatatacaaatagtccctctacctctttgttgctgtcgccaaaatcgttgtaactctccccagtcttgtacacaaataccagcaacgtatcctcgccctgaaagcctgaagccgccaaccccaatcgttcaacatcaggctgatcgtcggtgactgccttcacctgagccgtgatatcgtaagaccagggggcactccaactgccgtcatgacgtaaaaatgccagtttcagcgtaaaacggtcataagtttccaccggatcggtgccatttttcgcgacttcctcttttccacccagataaggtgcaggcgctccctgaacatcaccggacgcaccgcatccccgtagggattgagtgcggtatcaatcttcgtccactctttccaggcattggccgccagtttacccgcctgcatgcgtgagatatccacgttacgccagtagtactccggcagattttcccgcgtttgcccgacaaaccaggtcagcccggtgtcactgttgacgttatcgtgataggcgctgacgactttcagatccgccacagtttcaaagcgggtcaggtaggttttaaaggcctcctccaccgtatcccggctaagcttgctctggctgatgttttcgagcagttcatccatcatccgtgtctgcccgatacgctgggtcgggtcaaggcacagcacgctactcaggcgctctgcggtatgatctgccagcgcctgagcctgttgcgcactgagcccggcttccatattttctgccagggtctgccactcctcccaggaaggtagctccggctcggccttgttcggtacggtcacgtaacggatattcaccagcgtccggataaccgacggcatggtgtgcagtgctgatgccacatctatccactgcagcacggtatcaatatcctgccagcattgaaggcgactaacgccggcgcaggccatcgcttgtgtcaccatactgatgtccagacccatcaccgaagccagcctgtcagccgtcaacgtctgttggcgcagcatatccagcgtgtcagagctggggttacccagtgcgttaatccattggtggaatcggtaaagggataacagggtatcaatattgtgctgcccggcaggctgatttttggtttccagcacggtaaagccagagatgaccagtacggacagctccgcttcactgaggcgcagcacctgcacggaaagcgacagctgcgccatcacatggcagaactgcaccagttgggtcgtttcatcgtcactcagcgtctctttcagcaccagcatcataaatccggcgatattcaggccgcccggtcgcaaattatctgtccataacaggatataacgcgccatatccggtgacgccagattcaacgtagcagcaataaacggcgcgagaatttcagcctgtagttcccgattgtcactctgcgccatctcctcactgaggcggggcctgagggtattcagcagattactgatttccggtgaaatattcctgctgaactcgggtgtacataacaaccagagcgcttccgtggatattcctgcctcaaccaaccattgcgtcatttgatacaaccagataaccaatcgtgataactctccagaagacagggaagttgtcgttttgcccctgaacggcgaaaaaccataaagcatacataattcattgactgtcagctgatgggctcgggccagcaacgtcagacgataaagcgaagtgatcacggggacagaaagggtgatgttattttttatgtccatcacaccagccagtttagctagttgatacagctcaccgccattgacgcccaagccccgcatcagggccgaacaggcaaaggtcgcttgctcctcacccgggtcaatgctgaccgtgctgccgtcagcttcaaagattttcccactcagcgcaggggtgttaaagagacggttaaagtgactgacgctgtcgtcgtcgacacactgattgatgatggctccgctcagcaccagcgcttcatcaaagctcagagcataagagtgactgtagaacaacgtgtagaaaactcgggtcagaaccgagtcgttgatgatgccctgtgaattatcactgagtaggatagtttgcagttcattcggtgaaagtccgctagccaggcacaaacgaatggctttattcagtttgagggcgaaaatgctcagaggataactttcgaaagtaaagacagcagtccacccaatctgtccattgccgctgcgattaaaatcaaatattgttgccccctttttcaactcatcagcggtaagcggtgacaacacgccactttgataaactgtattcgcatcggttggtgcagagatagaacctatggccttgctaccgttggtcgttcccacgttacttttacggattgtgagagcgccaccactttttttaaaactggctctgataatgaaatggttgtcgccttgatagagcaggtcccaaaagttcaggtgtttagtataatctccaccaggaacccgggttatcttgtaagcttcaagtttatcttcctggtccgtcaacaggcccgttgaaatattatcaatataaaccgagacgttgtcagaaaagtcgttttgcaacatcccgagatatttttgaacgtcagaaagttcaaggccataatgctgggctatccatgcttgtgatgcaaaattctcgggcgtgatattttcaccgaagtttttcgcaaataacgcatccgcatttttttccgtaatttcctcggtcaggatgttataaagttccggtgagatattggccagaatagccagcaatgaagccccttccgcctgccccatgacgtctgggttacgggacaatgctgacagggtacggtcatgcgccataatgacctgacgaacagcctcataaggctgatggtaaggcgtgtcaacggcctggcggtaagtcgacaggctctccatcagtgcttccgcgtcactttcggtctgacgggtaatatgcgccagcaacagttcattagacagtgccagagtggagatttccgagtccatgttattctgactcagcgtcaggtcagccaaatccgggcggcgattatcaagatgataagccgagcttgtgaaatgcagctctttcgcctcacgatacaactctgtgaggtagccggccggcgagaacatggaggctacggagcctgggttcacaaaggaagaagagcgggagccaaacatttcatcgtaactgcgtgaagcactgtctcgttcaataccccgacggatggcgccggataattgcgggttggcgcgggtgaaaatacgggcttccagcaggcgatgacgtttttttgttcaacagtttcacgatagagataatggctttcaccccaactgagttggtcatcaaatgtttttctcagttcactgaaggaaaggtgctgaaggtctgcgagagtcatcgtcctaccgtcgcgagtaggactgattttgttcagtaatacatccgcactgtacataataaccccaattattttataaaatagagaacttggctaaaggtgtctcagagagttttggtaaccaatatcttgtagactattatcctattttcgatgtaatcttgcgtttcaattgatactaatcatattaaaaactgcgctattgcaaatagtggaacagagtgcgtattcttactgagtttctactttaaacccctaatttataactaagctgactaaataaagcgacgctttacaaacattcaaatccacgctatagcgacttaccattaattaataatagggagtactgtattttgtacttattccggaacgttatttttgatattttaggccagaaaatagggtaaaatataataaagcaagttttaaattatctttttctactacatgctgatgagcgctatccacaatattttttctgaatccgcttatactacaggtggctaatatacaccttattatttaggaagaaggtcttggcaaaatgaataaatcattatgtaattcagcattaaaattaaatggttatttaggcatagagaatgacgaatcatctgataatatttttaatatacttaaaactccctgcaatgattaccagtcgtcagtaaagaaatttataaagctacttaattacattcaggataataatattgatataacatcatttaatgaattggttgcgcttcatgaactcgtagctccgcatgatgccgctgtagtttctatgatgtcaattcattttaatctggccatagggactatcgccaacttaggtgctcaaacaccatatatagaaaatctataccaacagctttgttcaggtagtgctattggcgtatatctggcgactgaactggcttacggtaataatctgatagcaatcgaaacacaggctgattatcttccggaaaaaggtgtgttcatacttaattcacccaatcctggtgcatataaatttatgcctaataccctaccatgtgagttaccaaaagtagctgtaattttagctcaactaaatgtatcagggaaaaaatatggtattttcccgtttgtactccctctgtcagtaagtggtcagttaactgttggagttaaaatcacttcacttggcgataagccaggattttatcttgataacgcaataacttcatttgataacgttgaaattccttttgaagggctccttgctggcaatatgatcacattgaccagaaatggtcaggtatcattacatactaaaagattaaaagagcggttttcgttaattacaaaccgaatacatactgggaaattatgcatggccgtaagctcggttgcaggggctaaatcggctcttcatatcaccagtacatatggtaataaacgacaaactttcggctactcaggggctatgccaataattaattattttcatttcagagagggcgtagcttgggataccctgagtacggtcacacatgcattatatttaagagaattaaccaaaaaagtttcagtaatgctatcaggctctgttaaaaattttaaattctcagatgaagtacttattgaaattattactgcaaagtccttgtgcacatggcgtacacaagaaatattaattaattgctgtgaacgctgtggcgctcatggattattttctatcaacaagataccccattatttaatgggcaattttggtgcaattaccgccgaaggtgataacgttgtactctccctgaaggctggagagatgatttttattggtggaataaaaaataataaagaaaatgttcagcatgatttatttttcattctgaatgattatatggattttttattacaaaaactgaataaattaatagtcagtggcagtaaaaaaacaaatttcgatgctgttaataagtatagcggtgattttctggagttaagccagacatatgctgttttatccgtagtgacgacaatcattgatgcatatcacactgatgacattgacatgattatcgaaggttatcttctcgactgggttcaccgtaccatgagtaacctcttaataggtgaagtcattgattttcaggaagctaaaaaaatagatgaaaggcgcatagagtatatacgtaaatacgcagaaaaaataaatgattatatttccgagtttgcagtggataaatctggaattgaaacaccaatatccagtgatgactatatatcctggtatgcaggaaatcataatcagttaaaaaattaactaatttttatacaaggaaaagaataaaatacagtatatttttataaacactcccgggctgattagcccagtttaaattgtatctcgtttttatttatcctgcttactcataatggattgaataaagatctttttctaaaaaacggcaaaaaaaagcttcatgccacaacatgaagctctctggtatcaaattattatcttacaaaactacagtgcacggaggatcgcttcgacactggcttttgcatcaccgaataacatctgggtattttctttaaagaacaacgggttttgtactcctgcatatcctgtattcatagaacgtttaaagacaattacgttttgtgctttccaaacttccagtacaggcattcccgcaatcggactgtgtggatcttcttgagctgcggggtttactgtgtcattggctccgataaccagaacggtatctgtctcagtaaaatcattgttgatttcatccatttccaaaacaatatcgtaaggaactttggcttcagcaagcaacacgttcatgtgacccggtaaacgccccgcaacaggatggataccaaagcgaactttaacgcccttctcacgcaattttgcggtgatgtcatgtaccggatattgcgcttgagcaacagccataccatagcctggcgtaataataactgaagtggaattttttagcagttcagcaacgtcttccgcgtttgtttcgcggtattcgcccatctcttgttcatcacccgttgaagtaccatcagtaccaaaaccaccggcgatgacgctaataaaagaacggttcatcgctttacacataatataagaaaggattgcaccagaagaacctactaaagcaccggtcacaatcagcaagtcattgcttaacatgaaaccagcggctgcggctgcccagcctgaatatgagttcagcatggaaacaacgacgggcatatctgcccctccgatcgacgacactaagtgccaaccgaaagcaagtgcgatagcagtcatcactagcatagtgaaaacttgcaaaccaacactttgggtttttataaagataaccatcagtacaaaggaaacaatcaacgcggccaaattgagtttatggcggtggggtaacatcagcggtttggatgaaattttgccgcgcaatttgccgaatgccacaattgagccagtaaaggtgactgcaccaatgaagatccccaagaaaacttctgtcaggtgaatgttttccataatgggagcaacaaaaatatcatgggcaataaagctgttgaacccgaccaaaaccgctgccagaccgacaaagctgtgcaagatggcgaccaattcaggcatttcggtcatttccacttttttggccaggcgaatgccaatgacagcaccgatgatcatcgccaaaataatccaacctactttgccagcatcgggtcccagaatagtggcaatcagcgcaattgccataccggctataccaaagatattacctcgcctagaactttcatggcgggaaaggccggcaaggctgaaaataaataaaatggcggcaacaatatatgccgctgtaactactccgttcgacataagttaccccttaccctttacgaaacattttcagcatacgctgggtgacggtgaaaccaccaaaaatattgatgctggcaattaaaaccgcgatgaatgagaagaaactcacccatccaccttcaccaatttgtaggactgccccaacgacaatgatccctgaaatggcattagtgaccgacatcaggggtgtgtgcaatgaatggctaacgttccagacgacgtaataaccaaccacgcaagacaaagcaaatacggtaaagtgagacaaaaactccttcggtgcaacgtttgccaaccagccgaacaggataatggcaagagcaaacaaaccatatttcaaccacggagatctcggctttgctgctggtttatcttctttcttcttcagcgtcgcaagtttggtgggtggagcggaaacttgaataggaggggctggccatgtgacttctccctctttaattacggtaacgccacgtacaacgacatcttcaaaatcgatagtgatttcgccatttttctctttgcacagtaacttcgcgaggttaaccagatttgtgccgtacagttgtgacgattgagtgggtaaacggctaggcaagtcggtataaccaatgatctttacaccatttggtgtcacaacgagtttatcagcctccgtcagctcacagttacctccattctgcgcagctaaatcgacaatgacactgccaggcttcatggactcaaccatttctttggtgatcagccgcggtgcaggtttccccggaatcaatgccgttgtaacgataatatcaacttcttttgcctgtgcagaaaacaattccatttctgccttgataaaggcttctgacatgatttttgcatagccgtcaccactgccagcttcttctttgaaattcaattccaaaaattcagcacccatgctttgtacctgttctttaacttctggacgggtatcaaaagctcggacaatagcgccaagacttcctgccgcaccgatagcggccagccccgcaacaccggctccgataatcataactttagctggtggtactttgcctgctgctgtaatttggccagtgaagaagcgcccaaattcatgagccgcttcaacaatagcccgataaccagcaatatttgccattgaactgaggacatctagtgattgcgcacgggaaattcgtggtacggcatccattgccagaaccgttactttacgttctgacaattttgtcattaattctgggttttgtgctggccagataaaactaaccagcgtcgccccttctttcatcagggcaatttctttatcttccggggcattcactgtaaaaataatatctgattgccaaacttcatgatgttctgcaatatcagctcctgctttttgataagcaatatcatcaaaactggcaagatgcccagcccttgtttccactctaacgctgaaccccaatttccgcagttgttccaccgttgatggtgtggcagcaacgcgagcttcattggaaagtcgctcttttggtacaccaatatgcataatgtttccttctctaagaatgaaatattgctgattattacctgttgaagccaatttaacgataaagttgattttattactgctatcaataaaacctatcaataaaaaataaaatagtcactaattgaaaacaatatcagggaaaaataaagtgaccttcaatgtaaacgatgctatcgctcgtataaatcgctatttttattaaaattgctggcaccatgtaccaaaaactaacactcatttatttagatagtataaatttttgcgacaattggcattattacatgtaataattgcggcctatgtgatacataacaatgttcagcacgttataaatattttaatgcgcaaggctaaaggattttttatgaagctgaagacaacgatcatcgctacagcgatgctctcgctaacaacgattactgctgcacatgcggctaaagaattaacgccagaacaagctgtagagctaaagccatttgaacgaatctcagtcactggccgtttcaatgcaatctatgaagctgctgatgcgatttcccgtcaggcggataaaaaaggcgcctatagtttctatatccaaagtctcgacgattttaatggtggtggtaatttacgtgttgtagccgacttgtatcataaagatgcagaaaaatccgataaaacaactaactatcgcatttatcgtggaattaaagagctgcctaaaactgaagccattacgctggaaccttttgatactgtaaccgtgaatggttactttgctactgcccctgatctgaaagaggccatcgctaaggctgctaaaaagaaagatgctgcctctttctttattgttcgtgatatttctcccaataatggcggaaaccaaatagttactgcatatgtttataaaacagatgcaccgaaacgtcagatacagtctaataatgcggttattccagcagattcggagactggccgtcaggcactggctcaaggcggcgaagaagccgagaaagttgaaattccaggtgttgcttcctcaacttctaccagcaatttggttgggcgattttttgaaacccagtcatcaaaaggtggtcgttacacggtcacgttatctgatggcacaaaaatggaagaactgaataaagcatctgccgctcaaatggttccttttgactcgattaccttctctggttattacaccacggatccagaaatttcttatcaagtggctaaacgtgcagcgaaaaaaggcgcgaaatactatcatgtcaccagagagtggcaatccaatggtggtaacatcactgtcagcgctgatttattcaaataattaatctgttattgatgaaaaaggcacaaatgatggtttgtgcttttttatcatgaccagaacacgttttttaaataattcgttctttatatatcccgcctaacacacattattttatgcataaaatttatatttttttgcatagtcacccattgcatacaatcctttcactccgtagaatcgccctgtttttggatttaacgactgaatcttctctgcaatccagagcatggatgcaataaatgtccaatatgtgttcgatattcagaacaagtgttctgactaatcgtgtcgattatattactttcaggaacctatctttggaaaaaaaattaggcctcacatctctgacagcactggtacttagctccatggtgggagcgggtgtattcagcttgccacaaaatatggcacaagtaggcagtcctgctgcattaatgattggttgggggattacaggcgtaggtattctctttttggccacttctttgctattgctttcacgtcttcgccctgacctcgacagtggaatttttacttatgcaagagaaggatttggcgaattagttggtttctgttctgcatggggatactggttttgtgccattattgccaatgtttcttatctggttatcgtctttgcggcattaagtttttttactgacaccgaacattcagttattttcggtgatgggaatacctggcaatctctgattggtgaatctattttgctttggtttgttcattggctcgtactccgaggagtacaaactgcggctagtatcaaccagttggctacagtggcaaaactgttaccattgggtatgttcatcattttggccgtaatttcattcaaaatggatgtctttacgtttgacttcactggcattgaaatggggatacccgtttggcaacaagtcaaagatacgatgctgatcaccttgtgggtttttattggtgttgaaggtgcagttgttgtttcagccagggccaaaaagcgcaaagatatcggtatcgcaactgttctcgctgttgtttcagcattaggcgtttatatcctggttaccctgctctctcttggattggtagcaagacctgaattagcggcaatgcgcaatccttcaatggcaaacctgatggtagggttaattggctctgtgggtgaaattgttattattgctggcctgatcatttccgtttgcggtgcttatttgagttggacaattatggccgcggaagttcccttcatcgcttcgttacatggctcatttcctaaggtattcaataaacagaacgctaaaaaagcacctgagtcatcactgtggataactaatggagctgttcagatttccttgatcttaatctggttaagtggcagcaattacaacatgttgctttctattgcatcggaaatgatcctcgtcccctactttctcgttggtgcatttttagtgaaagtagcatttcaacgtagtaaccgggttttgttgttgattgctgtaggggcctgtacttatggtgtgtggttactttacgcatctggtttaatgcatttgcttctttctgttgtattgtatgcacctggattgcttgttttcttgtatgcacgtaaacagaatcagggacaaaagccactgaatatactggaaaaatcaactattgtgcttttgatactaatgactatcccctctacatggttactaatacattaattatctatccatctgtttgataagtatataagttattttaagccccttattaaggagagaatcatcaatttctctccttaattttttgtttgaaataggaaccctattgagttttttttgttgtgtttttgcggtgttaatgggatttgtttttttaaacttataagtatgttgtaactaaaatgaaggaatatggataatattcatgcaatccataaatattaatactatttccttgatgatttatttttattaattaataaacaaaaactagatttttatcatactggactaggctgtgtcccttaatgtaaattgatagcattatcatctaacttgttttcaatacgggaaaaagatgatggcacgctacgacattcctgatgacgcatggatagtgatagaaccttgtttacctccggtccattcagagcgggcaggacgtccacatgttgaacaccgccgagtgatgaatgggatgttctgggtcttgtgctctggggcaccgtggcgtgatttacctgaacgctatggtccttggaaaacggtctataaccgatttaaccgcgggtcaaaatcgggcattatcaacaagatatttaaccggttactgtccattctggatgaaaaaggcttgattgactgggctgaaatttgcctggatggcagcaatattcgcgcgagtaaagatgccgcaggcgcgaaaaaacccctcccgatatcgctgacgatcatgcgctgggtcgctcacgcggtggttatggcaccaaaatccatctggcaaccgacagacggggttttcccctcaacctgcttttgacggcggggcaagtccacgaaagtcgatccgccatccctttgctcgacggcattggtatacagcgcaaaaatggtttcatgaaacggcgcggcaaagcggtgctggcagataaaggctattcgggcggaaaactccgcggttatctgcgtaagttgcggataaagagcattattccgtataaaatcaatgaaaaaggcagtactgatggtcgcacacaatttgatgagcaggcttatcgtgaccgtaatgttgtcgaacgttgtttcggttttcttaaaggaaatcggcgtatcgcaacccgttacgaaaaaaccgctcgaaactatttgtccagggtgaaattaggctgtattcgactcttttacaggcggttatctaattaagggacgcagcctagttattattaacagagagttaactttaattggatggaaaatttatcatttagttgaattctggctataaactctaacaaatactaaatttaaagcgtttaagttacccaaggaacatgttgtcacaaataaataatacttggttaaaaacatggtaaagtattcaattacaaaaataaacacgtttaaaatcgcatttattttcacggaatttcatcaactaataattaatcttataaaacagaataaacgttcatccgcggtggaaaaacattccattttctgaataacaatgctattaatatttacttaatagtaaaaaacttcaaataatgcattatggcgagttattatttttatctttgtcaattaatcgctactatattcttcgaaatatctgtcgataaagaaacgttaactaacgtctctttgttgtgtttcggtataaattcggacaaatcacttgctgtatcataattgtacggctttaatgttaactcaataatctatatctctgccgtatcaattcgtcagggatgggatatattaaaaatgaaaaccaatctaattatttcctctttatttgtatcatctgtatttgtatccgcagcatatgccgccgatggacaaatcaaatttacaggcgacattaccgcaactgcatgtaaaattgatcctagttctgcaaaccaaactgttaacatgggtactatcagttcaagttcattcaatggagtaaatagcgcatcagccgcaacacgtttcagtatcacactgactgactgccctacagaagttaattatgcccaagttaaatttgatggaaatccggatagccgaaataataaccttttggcattaaacaacgacaatccaaagaaaaaagcggctgatggagttgcactcggtctttatgaagccgatagcgcaactcttatttctctggcgcagccatccaaatctcagaaattgactaataaatccaaacaagaattgaattttattgctaaatatattgctacaaattcaactgttaaccctggttccggtgatgcggtagccaactttactattgtctacaactaaggatttttatggcagggatgcccaaataatacaatatagccaatgaataataattaatttaatctattcattaatagataaacataatattgtttggagcaaccactttgaaatattttcgtgtttttattttcattattatctacattttcagcaccaatatttcttttgctggtatcgttatcggtggcactcgtgttgtgtatattagtgaccgaaaagaagcatcaatctccgttagcaatcctgaaacagatgtttcttatcttattcaatcatgggttcaagatgaaaataatgaaaccaaagttccttttattatcactcccccactattcaaattaaccgccggaaatgaaaatattctgcgaattgtaaaaactggcgaaaacttgccaaatgataaagagtctcttttctggcttaatgtcaagtctatcccaggaacagtgaaatcagatcagaaccaattgcaaatcaccgtgaaatcccgctttaagctattttatcgccctgtcggtttagcagacaacgccagtattgcctacaaagcactgaggtttaaaaccgtaggacataagctaatcgcagagaacccaacaccatactatatctcgttttcggatctaaccactgaaaataattcaataaatcatgaaataaaaccggcgggtatgatatctccttatggtcaattaagttgggatattcccgttaaaaatatcaactatgtcacttggaaaaccatcaatgattttggcggtgtaacgccagaagaaaaacgcatgttctgaccataaatttacacaatatatcaaggttagaaaatcattatggataactaccgtcattatcttcaacataatatttctgataattgggtattatttatcaagccaagcaaagtgtttttatatgctgtaacaatcacatggcttttcactcattataatgaggcttatggtgaagaatatttcaatatcaatgcgttggaaactcactccggctttccagaagatattgatctatcaatttttactcaagataatcagcaactacctggccgctattgggtggatatttacctcaatcgggaaaaagtagacactgggaatgtcgattttagcattgtaaaccataagctatcgccgaagattaaactacagcggttaaagaagatgggagttagtattgactcattcccctccttacgtgatttaccacaagaaacagaaatagctgatcttgggcaatatattccatctgcatcatcttttttcgacttcaataagcagcggcttgatatcagtattccccaagccgctctgaatagccaagtcagggattatgtttcatctcatttgtgggaacaggggttaacctctctgctggttaattataattacagcggttcaatcaattggctgaataatcaacctggatcgacaagcaacaattttctcaatcttagaacaggcgccaattggggagcatggcggttgcggaattactctacttacagcagccaaaaccacaaatggcaaagtcttaacacttacctacaacgtgatattcatgccctgaaaagccagttggtatttggtgacagttatacaccttcaaccatttttgatggttttcaatttaggggaatgcaattagcttctgatgacaacatgctgcctgatagcctgaaaggatttgcacccacgatacggggaatagcccaaagtaatgctcaagttaccattaaacagaatggttatatcatttatgaaacctatgtttctgctgggccttttgttatcagcgatctctaccccaccacatccagtggtaatctggaaattattatcaaggaagcggatgggagagaacatcgttctgtacagcctttttcagccgtgcctatcatgttacgggaaaatagttggcgacactccctgactctggggaaatatcaatctttcactcatcgtggcaaagaaccttattttatgcagggtatggtgatatatggtatttccaaccgtgtgacggtttatggtggaaccaccctctcaaaagattatcaatccgctgccttcggtacaggatatagcttttctgattggggttctctctcctttgatgtcactcatgcaaaatcagatttagctgagaatttcagtgattcagggcagtcatatcgtttccagtatgcaaaagatctttcccaaacaggcactaacctcactttagcgggttatcgttattcgactcaccgcttttatgattttaaggacgccaatgagatcgatattacagacaacaaagataaccgcagcaacaccaataaacgcagtaaattacaactgcatgtcaaccagtcactggggaatttgggaagcgtttatctatctgcttttcagcaaaattactggtaccaacaaggttacgaacggaacatcagtgctggttacaataccagttatcattcaattaattataatctgaattatacctacagtgaattccccggctcaaaacacaatgagcagattttatcattcagtgtgcaaatcccgcttgatcgctggctgaaaaatagctgggtaaattataacctgaccaacagtaaaaacagggatacgtcccatcagatcagtctcaatggtacagccctggaagataacaatctgatttacagtatccagcaaaattatacccatcacgataaagatattggcgggaatatcagtgcggaatacaaaggtgcatatggccagatcaacgcgggttacaattacgataaacaatccaaccaactgaattacggcttaaatggcggggttgttgcgcatccttacggtgttacgctttcccaatcattgggagatacactggcattagtacgtgcccatggtgccaaaggggttaaagttcaaaatcataccggtatttcaacagactggaacggctatgccatcgtaccttatgtgagtagttatcgtaaaaaccgtattgctctggatacttattcaatgggcaacaatgttgatattgatatcaatacgcaaactatcatcccaacccaaggctcattggctttagccaatttccaaacccgtattggctatcgcgttttaatggtgctttcccatgaaggtaaagtaatcccatttggcgcaacagcaacactggaaaaacaacatgatatcgatgacgccaacaacaccattgtcagtaatgatggacaggcttatttcagtggtgttcctaagacaggtcggttatgggtgaaatgggggtacaaggatattcaggaatgtcatgtggattatcaacttcctgatgaaataccgacatcaggtttgtacatggtgaatgcagcctgtgaataacgatatcagagtatctatttgatattccttatattatggaaattttatatggttaacggcttaaaattattattagcaagtacgtttatcgcgggcataatgagtagttttaatgctctggcaaattatgactgccaatattcgccgagtttttcagccggtactacatatgtctcttttggcactatcgttattcctagagattatccgattggaacaaccatcaaggaaattcgtcttgatgaagtgaatgaaaaaggcaatattgccctctgtaatacaaccacacctacgtcatgggaaaggccggactttgatcccgcacactacaactatgatgcgatttatgaatctggagtgcctggggtcggtatccgcatcaatacatggggacccggctatggtattgattggctacccagaacagtgacatacccagtcacttgttccccgccgagtcagtttccaaataaaaagcaatattgtggccgaacatggggttatttgaccgttcaattaatcaaaattacgccaacaaccggttcagggccaactcatcagaggctgctgaccagagctaaattggggctcgatctccctattcatgctttctttttgacaaatacttatatcatgactcaggggtgttccctcaaacaaaaaacgaccttcgtcaatatgggagaagtcagaaccagtgcgtttcgcggcatgaatagcacagccggcatgcgaaatttcgaattaaatctggattgcgatgcgaatgttaaagttggcgtgacgctggatggacgacctgcaaaaagcaatgccaataatatctgggcattggattataatagtgacaacgtcacggcaaccggaattggtttgcagatcttgtaccaaaatcaaccgttatcaatgggttctccgcttataattcactccggccaagtaataggcaattttgctattccactgcacgctcgttatatccaaacagaaggacgggtgacaccaggcaaggcagatgcaacggcaacgattacgttgacctatcaataaatgcaaatctccaagacgatccgccaaacacagcccaaaggccttttcacttcttgggctattcttttggtggctggattgtccgaaaggctgcaattttacctcgttgcccagaggacgataacagttaaacgaataattatcgtacaagtggctgctaaaacagccacttgtttttaatccgaaacagcatatttatccccttcatctagccagattctcttaataatcacacgactacaattcatgcaccccaacatcctcgcttacgatgtttctgccagaaacaaagtatcgacatcaaggtataatttagttaatttacctacaatcactcattgatatatctatttacagacaaaagttcttatcttgagatgtgtttaaagttcatttttatccagacatcaggttaatcaaagtcaatagttcttttattttcaggtagaagtatcaggttggatcttaattattacaaaggagaaatgagtatgtcacacagccaaaatcgctcctcagaaatttccttagccgttgataacaacaattctcttcttcctcatgcacacccgttgagttctcctcagcaagtcatctggctcgatcaggttatccatcccggttctcccaattacaatatcggtctttttacctgcatcgacggtgaattggatgaagccttgttcgctcgtgcttttgaagccgttgtttatcgtcatgacacactgcgtttacagctcatcaacacccacaccttaccgctgcaaaaggtgactgatacgctccccgtgttcatggacatacacgatttctctccgcatatcgacgcagaagcccaaaccaaacaacatatcgatgccgagtttatgcgtccgttccacttggatggagtgctatggcgtagcgaattattacgggtgagccatacacgccggtactggcagttttgctgtcatcatttgatcatggatggtattggtttatccatactcagtgaagatgttgtcgatacctacaatcgcctaatgaggggagaaacgctgaacagaactgctccttcttatctgaatttcattacggatgaccgagattatctggcttctcaacgctactcacacgatttgcaattttgggtgaaacgctatgaaagcctgccgccgccattgctcccaactgccaatcccaacaaagccgcaagtcacggtcaagccaaacctattttttggcaaatagacaaggcgctttttcaacgcatcgaagacaccgtagctcggcagggattatccgtcctgcattttatgtataccgttctggctagctatttcagccggacgacgggggcggatgaaattgtcatcggcattcctgtgcacaaccgcaaaaatgcccaacaaaaaaacaccatgggaatgtttgcatccgttattccgattggcgtgacaatttcaccagaagacacgttccttgatgtcatgcacaaagccgctaccgaattgcgtcgttgctataagcaccaacgttttcctattgcagagatcaaccgacaaacacatattcagcagaaaacggggcgtgttcaattatttgacattacattgtcactcgaaccgtttaaagccaacctgcatatggcaggagaagataccaacatccaattttttgatatacaccatggtgtaccctatcctctttcgatcatcatcaagcagtacacaaccggtcttggcgatgaccttcaacccatcacaattgaattcgatttctctaccgattacctgagcacctcagaagtcatggctctccaatctcgttttgccgtattgatcgacgccgccatcaccgctctggatacgccgatagtgaatttgcccatcttgcccgaggctgaacgccaacagatattggtggacttcaatgccactcaagccaatttcccgcaaaatgcattaattcatcaattgttcgaagcacaggtacaacgcaatcctgacgctatcgccgtggtctttgaaggccaatccctaagttatgacgagcttaaccgccgcgccaatcgtctggcccatcatctgattgcgttgaatgtgcgcccagacgatcgggtggcgatgtgtgtcgaacgcagtctggatatggtggtcggtttattgggtatcctcaaggccggcggggcttatgtaccgctcgatccggcctatcctgccgagcggttggcatatatgcttgatgacgcagcaccagtggctctgctcacacagacggtactgctcgacacactggtcagcagaatcatacctacgctagtgctcaacaagcccgaatcgactatagcaacgcaaccaacccacaatccggacgcgcaagcactcggcctgacgtcacaccatttggcctatgtgatctacacttcgggatctaccggactccccaaaggagtgatggtcgagcatcgcggcctgagtaatctgatctcgacacagcaggatgccctggcaatcgagccaagcagtcatatcctgcaatttgcctcaaacagctttgacgcctgtatctgggaatgctgcatggcacttctgggaggtgcctgtctccatcttgcccagcgcacacatctcctgcccggtgcagcactactggatactttggaatcccatgccattacccatgtgttgttgtcgccaacagcgttggctgcactggattccgttcctgtgacactacagaccctgatcgtaggcggagaagcctgcccatcctcactgatcaaacgctgggctaccggtcgacgcatgcttaatgcctatgggccgactgaaagtacgatctgttcaactatttatctgtgcgataaccaaaaagaagggactccgcctatcggcagtccaatctccaatactcgtatctatatccttgatccgcatggacagcccgtcccccttggtgtggcgggggaaatccatatcgccggtgttggcattgcccgcggctacctgaaccgtcctgaattgacggcggaacgcttcctgcccgacccgttttccggcatgccggcagcacgcatgtacaaaaccggtgatcgagggcgctggctggctgacggcaatatcgaatacctcggtcgtaacgattttcaggtcaagttgcgcggcttccgtatcgaactgggagaaattgagtctcaactggtacaatgccacggcgtgcgcgaagcagttgtccttgcccgagaagacatttctgatgaaaatacaccgggtgaaaaacggctcattgcttatctgctcgccgaaccaaatgtgaaactggtgccagcggaactgcgccagcagctcgcacggcaccttaccgaatatatgctgcccagcgcttttgtaacactcgacaccttcccgctaacgtccaatggcaagctcgaccgtcaggctctacctgctccggatcagatggcggtcgtagcgcgcggctacgaagcacctgccgatgaaatggaaacggcattggctgagatttggcaaatgttattggggctggaaaaggtgggacgttatgaccatttctttgagctcggtggtcattcgctaatggcagtgaacctgatcgaacgactgcgtcgtcggggctgggttcttgacatccgtaccgtcttctccacaccagtgctggccgaaatggcgcaagcaatgctgcttactcaagacagtgctgccgctttcaccgtgccacccaatctcatccctgacggctgtaccaccattacgcctgatatgctgtccctgatatccttgtcccagcgcgagattgatactattgccgccaacatccccggtggtgccgctaatattcaggatatctacccactcgcgccattacaggaaggcattctgtttcatcacctgttacaaccgcaaggtgatacttatctattacgcagcctgctcgctttcgacacccatgaacgcctcactgccttcctgacagccttacaacaggtcattaaccgccacgatattctgcgcaccgccgcctgctggcagggattagcacagccagtgcaagtcgtctggcgtcaggcccctctgcgcaccgacacgtttgtgccgaccagtgacaaggacgtccaatctcaatttctggcacacaccgacccacaccagcggcgtctcgatttgcgtcaggctccgcttttctccatcgatatcgcccatgatccgatccagaacgagtggttgctggttctgtgcttccaccatctggtcagtgaccatatcaccctggaacttatcatcgctgaaatcagcgaactgttgcaaaatcgtgccgaaaacttacccgcagcacagccttaccgcaattttgtcgcccagtccctgagcgtaccggcttcagagcacgaaacttacttccgtgaggtgctcgccagtgtggatgcgccaaccactcccttcgggatactggatgtccacagcggggatagacaggtgacggaagccacgcacctacttgatgcggtactggccagggccatccgcacgcaggcgcgccgtcaaggtatcagtcccggtgtgctgttccatgtcgcatgggcgcaggtgttggctaaaaccagcgggcgggatgatgtggttttcggtacagtcttactggggcgtatgcaagggagtgcaggcatcgctcggagccttggcctgtttatcaataccctgcccgtgagggtccggctggcagggaacagcgtacaaacgaccgtgcaaacggtctaccgtaatttgacgaggctgctggaacacgagcaggcaccacttacgctggcgcagcgctgtagtggtgtggcaccgcccctgccgctcttcagcgcactgcttaactatcgtcatagtcaaccagagacaacctttgccgcgtgggaaggtaaaggtatacgtctgttggcagaacaggaaagaaccaactatcctctcaccttgtccgtggatgatttgggtgaaggcttccggctggttgcccagaccgtgccgggtatcgatccggctcgtctggccgcctatatgaccaccgctcttacaggtctggttgaggcgttggaaaccgaacctcaacggccgatcgtgaacctctctattctgcccgccaccgagcaccagcaactgctggtcgatttcaacgccactcaagtcgacttcccgcagtatacgttaattcatcaactgttcgaagcgcaagtacagcgcacaccagatgccaccgccgtggtctttgaagaccaatcgatgagttataacgagctaaaccaccgtgccaatcgtctggcgcatcatctaatgacgttggggatacgccctgatgatcgggtggcactttatgtcgaacgcagtctggctatggtagtcggtttattaggcgttctgaaagctggcggggcttatgtaccgctcgacccggcttatcccgacgagcggctggcgtatatgcttgaagacgcgacaccaaaggtggtactaacccagaagatgctcgccgatcgtctggccagcacagtgcctacggttatgcccataataatactcgacaacccagaaccattgattgaggctatgccaaccgataatccagatgcgcggtcactgggcctgacgtcacgccatctggcatacgtgatctacacctcaggctctaccggtctgcccaagggagtggcgatcgaacaccgcaatacggtgaatttcctcacctgggtacaacaagctttccgccctgaagagctagcccatacccttttcgctacctcgctcaattttgacttagccgtgtacgaatgttttgcgcctttcatctccgggggcacggttcatcttgtttctgatgcgctttcgctggtcaccaaaaaaccatcggtcagcctaatcaatacggtgccatcggccatcacgcatttgatcgacactaacgcgatccctgcggctacccgaacagtcaatttggctggtgaagcactgaaaccgcacgttgtcgaacaattgtttgcttgttcttctgtacaggaggtgtgcaatttatacggcccttcggagacgacaacctattcaacttgggtacgcatgaaccggatgactggctttgtcgctcatattggtcgcccaatcgccaatacccaaatttatatcctcgacgccgacagtcaacctgtcccgctcggtgttacaggggaaatccatatcgcgggtgccggtgttgcccgcggctatctgaaccgccccgaactgacggcggaacgtttcctgcccaatcccttcgcaacaatagccggagcgcgcatgtacaagaccggcgatctgggccgctggctacccgacggcaatattgaatacctcggccgcaacgattttcaggtcaagctgcgcggcttccggattgaactcggagaaatcgaagccagattggtgcaatgccacggtgtgagcgaggcagttgtgattgcccgagaagatatttccgatgaaatttccgatgaaaatagtgcaggtcagaagcgtctggtcgcctatctgctgcctcaggcgggtgttgaattggaaccaatggcactgcgccagcagctcgcgcaacaccttgccgagtatatgctgcccagtgcctttgtgacgctcgatgccttcccgctgacgcctaatggcaaactcgaccggcaggcgctccctgtccctgattcatctgcggtggtgacgcgtggctatgaagcgcctgttagtgaaatggaaatagcactggccgagatttggcaagtgttattagggctggaaagggtgagccgttacgaccatttctttgagctcggcggtcattccctgctcgcgatccagcttgctgcacgagtacgccagcggctggcgttggaactgcccttaccgcaactctttgcctaccctgtcctcgctgatttagctgccgtactcatcggcgcatcagtagccgcgcaaaccgtcattctgaccgccgaccgccgtcagtcactgccgctttctttcgcccagcaacgcctgtggttcctcgcccaactcaatcctaaggccagtctggcctaccatatccctacggttcttcgcctgcacggacagttagaccacaccgcatttacagccgcactcgacaaccttgttgcccgacaagaaagcctgcgcacacgttttgtcctgattgatgaacagccttaccagcaaattgacgacgcggatatcggttttaccctgatttgtcaggacctgcgcggattagacgaggcttcccgcctaacccgtattgacgaattgatggaacttgaaacacaaaccctgtttaattttgccaacgaaccgctggttcgaggtcaattgctgcaattggcggacgaagaacatgtgttgatcctcacccagcatcatctcatcaccgacggctggtcagtgggggtattgatccacgaactgagagcactctactgtgccgcgcttggggagcatggtgatcctttaccgcccctgtctattcagtatgccgactatgccgtctggcaacgcgaatggttgcagggtgatattctcactgcgcaacgggatttctggcgagagcaacttcagggcgcaccgtcgctgctggcgctgcccaccgaccgaccacgctcaccagagcagcgttacgccggcagccatgtgcctatccatctggatgctgacttattgactgccctcaaggcactcggacagcgtcagggcacgacgttatttatgaccctgcttacggcttgggggatcgtgcttacccgtttgagtggtcaggacgatatcgtcatcggcacccccgtagccaatcgcccacggagtgaacttgaggggctgatcggctttttcgtcaataccctacctttgcgtatcgaattggggcagtgcaacgcagtggcggaacttagcgtagcagaactgctcgcccacgtccgcgagcgagcgctggcggcctatactcatcaagacctgccttttgaacaaatagtggaaaccctgcaacctgagcgtagcctgagctacagcccgatctttcaggtcatgctggcgctgaacaatacccccacccaatcctttgaattacccggtttatccgtttcgttggttgaacagacacatcgcagcgcgcactttgacctgacattgtcactcattgaaaccgtagatgacctcaatggttatctagaatatgcctcagatcttttcgaccgtgcgacggttgagcgcatggtgggttatctcactcaagtactgacggccatggcggccgatgaaacgcaagccattgcccgtctgccgatgctgtccgttgccgaacgtcagcagttgctggttgatttcaacgccactcaagtcgacttcccgcaacatgggctgattcatcaactattcgaagctcaggtacaacgcacaccgaacgccgctgccgtaatctttgagaaacactcgctgagttatagtgaactcaaccgccgcgccaatcaattggcacacagcctgatagcctttggcgtgcgccctgatgatcgtgtggcgatttgtgttgaacggggcttggatatgatcatcggcctgttcgggatcttaaaagccggtgctggttatatcccactcgatccagaatatcccactgaacggctggtctatcagttgtcggacagcaaacctgtcatattgctgactcagaagcatttacaaacacgcttctcaatacaagacctatccatctggctgctggatgatgaaattcatcaaaatagcgtggcgaaacagccagcgcataaccctgacagcgaacaaatggggcttcagccgcaccatttggcctatatcatctacacttccggttcaactgggcacccaaaaggcgtcatgctggaacaccacaatgccgtgagccttattcatgctcaatgccagatcagtgagccccgcttgggcgatcgtattctgcaatttgtgaccatagcgtttgatatttcggtgtcggatattttccctacccttgcatcgggtgccacactggttctacgtccgccccatatcaaaataccgaatatcacttttgtcgatttcttacgtgatcaaaaaattactatcatcaatataccgaccgccttctggcaccactgggtacaagagataatggcaggacgcggtggtttcagcccctatctgcacaccgtcattgttggcggtgataaagtagaataccgctatttaatggattggttgtcgtgcccagagacgcaatcctgccgttggttcaacgcctatggccccacagagataaccgtcactgccacggcactgatgatagatgacaaacatactccgtctattaccgacaacgttccaattggtcgcccgctgtccaatacccgcatctatattttggatgcgctcggtcagccagttcctgtcggcgtgagcggcgaaatccatatcggtggtatgggcgtcgcccgtggttattcgaaccaaccggaactaacagcagagaaatttgttgtcgatccattcagcgaccaccccaacgcccgcatgtataaaaccggcgacttgggtcgctggcggactgacggcaatatcgaatatctcggtcgcaatgatttccaggttaaaatacgcggttttcgtatcgagctgggggaaatcgaaaccagattagtacaatgccacggcgtgcgtgaggctattgtgcttcatcgcgaagtttctaccggtaaagaaatgccgggcgacaagcgcctcgttgcctatctgctcgccgaaccaaatacggaactggtaccagcggaactggtaccagcggaactgcgccagcagctcgcgcagcaccttgccgaatatatgctacccagcgcctttgtaacactcgatgccttcccgctggcacctaatggcaagcttgatcgtcaggcactgccgatgccggatcaggcggcggtcgtgacccgcacttatgaagctcccgtcggcgacatggaaatagcactggccgagatctggcaagcgttattagggttggaaaaggtgagccgttatgaccacttctttgaactcggtggtcactcactaatggtagtcagtctgatcgaacggctgcgcagccagggttggatcattgatatccgtaccgtattcgctacacccgtgcttaccgagatagcgaaagtgatgcagatagccggaggtaacacggccacattcactacaccgcccaatctcattcctgatggttataccgccatcaccccggacatgttgcctctggtgtccctgacgcaatccgagattgatgccatcaccgctacccttcccggtggggcggctaatatccaggatatctacccgctcgccccgttacaggaaggcatgctgttccaccacctgctgcaaacacaaggggatatttatctgttacatatcttgcttactttcgacacccgcgagcgccttgatgcctttctgacggctcttcaacaagtcattgatcgccacgatattctacgcaccgccttctgctggcagaaattaccccagccaatgcaagttgtctggcgtcaggcgcccctgcgcatcgacacctttgtgccggacagcgacaaggacattccttctcagttgctggcgcacactgacccataccggcaccgtcttgatatcagtcaggctccgcttttctccactgatatcgttcatgatccgcgccaaggtaagtggttgctggctctatgctgccaccatatcctcaacgaccatatgtcattggatctcatcattgatgaaatcaacgaactgttgcaccatcgtaccgggcacttaccccctgcactgccttaccgccactttatctcccagtccttacgtgtaccgatgtcagatcacgaggcctgtttccgtgagatgctcgccgacatagatgcgccgaccgcacctttcgggatactggatgtctacagtggggatagaccagtgactgaggttacaaaaccacttaatgcagcactgaccagagctatccgaacgcaggcgcgccgccagggagtcagtcccggcgtgctgttccatgtcgcatgggcgcaggtgctggcaaaaatcagtgggcgggatgatgtggtcttcgggacagttttactggggcgcatgcagggaagtgccaacatcgagcggattctaggtctgtttatcaatacgctgcctgtgcggatccaacttgcagggaacagtgtacaggagaccgtgaaagcggcttatcgcagtttgacgcgactgctggaacacgagcaggcaccactggcgctagctcagcactgtagcggtgtagcgccgcccctgccgctcttcagttcactccttaactatcgccatagccaatcggatgtaacccgcaccctatgggagggcatacacctgacagctgcacaggagaggactaattatcccctctacttggctgtggatgatttgggtaaaggctttctgttggcggctcaggccgtaccgggtatcgatccggcgtgtctgatcacctatatgaccaccgccttggcgggtctggttgaggcgttggaaacagaacctcaacggccgatcgtgaacctctccattctgcctgccaccgaacatcggcagttgcaagataccttgattcagcacttcacccaatcccacggagtgcgtgaagaaactgtcgtgactcgcggctatgaatcccccatcggtgacatggaaacggcactggcccaaatctggcagaagctgctgaaactggaaaaagtcggccggcatgacaatttctttgagttgggtggccattcgctgacagcgatacaattgctggctcgtatgtatgagcaaaatatggagattccgttagcggcggtgttcactcaccccaccctgtgtgagctggcttcaaccgtgggtaagccgacttccccacttgtcgctgagctatggacaaaattagcaaagaatttttatcctaaatagcagtgtagtcatcgttatcttttatcggacaatgtaaatacggggctgttgagttaccaacagcccctgagcactacatagcgatattttccattacctgcaaaatacgcttatccgaaattgggtacgctgtccccaattgctgggcaaacaggctgattcgcagttcttctatcatccagcggatctctttcacttcaggcagttgtttctgctgaatagaaagtttcgccagccactgctgccattgccgttggatattttcaatccggctcatgtgtaccctatccctgtttggatcaatcgccaatttttccaaccgacgttcaatgccattcaagtaacgcaaaacatccgcaagacgtttccagccgtgagaggtaacaaaaccattaaaaactaaactggaaatttgttctttaatatccgacaaggcaagcgcgagtgcgatatccacccttcccttcaaacgtttattaatagaaaaaaccgtcgtcaagatctgctcgacttgtttggctatatcgaccactgcatcattcagatcagcccgaactttattctgcaaacttgcaaatgcttcttcattccatgcgggcccaccattttctgcgattaatctatccacaccgcaggaaatgcagtcatcaatcagatccagcacttttccatagggattaaaatacagcccaagtttggatttgttaggtaatttctcatgcaggtatttaatcggtgacggaatattcatgagcagcaatcgacgagtgccttcccacatcgcattttgctgttcggattcagtttcgaacagtttaataccgatgctgtctttttcatccaccaatgccggaaatgccttaacagagtaaccgccgcgtttctgctcgtaacgttcaggcaactcaccaaagctccagatatgcagcccgctttgttcaatgccatcatccgctaccgccgaaagtgtttcctgtactttccctttcaattgcagtttcagtgcagacagatccttaccttccgccagcggtttgtttttctcaccaatgatacgaaatgtgattttcaggtgatcaggaacctgatccaattgccaatcatcacgtgacactgtcacacccgtcatacggcggagttctttctcaaaactatccagtaaggtagcttgcggctgtgttacccgctccagaaatgcctgtgcatagttcggtgcaggcacaaaattccggcgtacgggttttggcagggatttaatcaatgcaacgaccagatcatgacgaattcccggaatttgccagtcaaaaccttcatctttaacttgatttaggattggcagcggaatatgtatggtgacaccatccgcatccgttcctggctcaaactggtaactcaaacggaatttcaaattgtcttgatgccaatagttaggataatccaaagcactaactttatctgcatcacctttaattaacatgctcttttcaaagttgagcagttcaggttgatctttactggcaacttgccaccagcgatcaaaatgtcgggaagacacgacttcttgaccgattcgctgatcgtagaaactgaacaaggtttcatcatccaccagaatatcccgacggcgggatttatgttccagttcttcaacttcttcgcgtaacttgagattcgcacggaaaaatgaatgccgggtctgccaatcaccttccaccaacgcatgacggatgaacaattctcggcataacatcggatcaatctggctgtaattcaccaaacgccccgccacaaccggcaagccatacaaagtcactttttccgttaccatcaccgcaccttgggatttctgccaatgcggttcgctgtagtggtgcttgattaaatgtgccgctaatggctcgatccattcaggctcgatgcgcgctgcaatacgcccccataatcggctggtttccaccaattcagccaccattccccatttaggtggctttttaaataatccagatcccggaaatacagaaaaacgggcattgcgggcaccagtatattcttgtttatcggtatccttctgaccgacatgagataacagacccgtcagcaacgcaatatggatactgcggtaatctgcttcttgactgtttatcagcaggccaatttctttaacaacctgccgaagctgagtatagacatcctgccactccctcactctgaggtaattcagatagtcctggcggcaaagtttgcggaattgcgagctggaaagcgctttctgctgttcaaccagaaaatcccacaatttcaggaatgcgatgaaatcagaatctttatctgcgaaacgacggtgtttttcatcagaagcctgctgtttttccagcggcctttcccgtggatcttgaatggataacgcagaggtaatgaccatgacttcacggacacaaccatgcgccctggcttccaacaccatacgtgccaatcttggatcgataggcaattgtgcaagttgccgccccattggcgtcagtcggtaagttccgcctgacagggattccggatcaatggctccaagttcttccagcaaacggacaccatcttgaacattacgtttatccggcgcttcaacaaacgggaatgcgctcacatctcccaagccaatggaggtcatctgcaaaatgacagaagccaaattagtacgcagaatctcaggatcggtaaattccggacgagataaataatcgtcttccgagtagagccggatacagatcccatctgaaacacggccacagcggcctttgcgctgattggcagatgcctgcgaaatcggctctatcggcagacgctggactttggttcgataactgtatcggctaatacgtgcaaaaccggtatcaatgacatatttgataccaggcacggtcagcgatgtttctgcaacgttagtggccaatataattctacgcccgacatgcggctggaatatccggttctgttcgctgttagataaacgggcaaacaggggcaggatttcagtatgcggaaagttatgtttatccagtgcatccgctgtatcacggatttcccgctctccgctcatgaaaaccagaatgtcgcctgaactttcatgccccaattcatctacagcatcaatgatagcttcaagttgatcccgatcactgtcactatcatcgcctgccaccgggcgatatcgaacttccactggataagtacggccagagacttcaataatcggtgcattgttgaaatggcgggaaaaacgctcaggatcaatagtcgcggaggtaatgataatttttagatcagggcgtttaagcaacaactggcgcaaatagccaaggataaaatcaatgttcaggctgcgttcatgagcttcatcaataatcagcgtgtcatactgcagcagcaggcgatcttgctgcaattctgccagaagaataccgtccgtcattaacttgaccagcgtattctcgctgacatgatcattaaaacgtactttataaccgacggttgagccaagcagagtttccagttcatccgcaatacggctggcaaccgagcgcgccgccaggcgacggggctgcgtatggccaattagccctttaacccctcttcccaactcaaggcagattttggggatctgggttgttttacctgaacccgtttctcccgcaataatgacgacctgattatcccgaatcgctttataaatatcgtcttttttctggctaaccggcagtttttcagggtatttgagcggaggacatgaaacttgacgattgataactttctgttttgcagtggcgatatcttcagatatggattttgccacggcctgcaaagaggcctgatttttgatttttgctgctccatgcagacgtttttttagccggaattgatcgcgcagcggcgtgtgctcaagttcagcgaataatgcagcaaatgatgctgtcaaaggtgattccacggtgataaatccttgtgatgttcttaattgagtagcgctgtctttattctcaacatcgcttttattgtcaacacaatatcttcttattgaaacactgagtctgagaacctatttcagtaagttaataggatagattcttattgattttttattaattaaaatattagaagtgtaacatatcttgagcacctcaataaacttcatctaaaccgccaatctgttattcaataaatttgaatgccaatctcgaaatattgagctattgcttgaacgatatacgacataagatagctgacaaatcgacacaattagcaacacattagttatcctgtgttaataaaggaattgaaatatgaataaagtactggttctgaaatcgagcattctggctcagcattcccaaagcaataaaatggctgattactttgtcgaaaaatggctggccaaccacgtagatgatagcattactgtacgcgatttagctgaaaatccagtaccggtgcttgatggagaattagtgggagctttgcgccctagtgatgcagagatgacagtgcgccaaaaagccacattagctttgtcggatgaactgattgcagagttgaaagttcacgatgtgatcgtgcttactgccccaatgtataacttcgctattccaatccaattgaaagcttattttgacctgattgcccgtgccggcactaccttccgctataccgaaaccgggtcagaaggtttgctgaaaaacaaacgtgccattgtgctgaccagccgtggcggcattcataaagataacccaacggatttgataacaccgtacctgcgtacttttttgggattcatcggtattaacaatgttgaattcgtctttgcagagggttttggattgggtgcagaatcagcagaactggctcatcaatctgcccagaatgctatcaatgatatgatgacaaaaatttcagcttaatgaatagctcagaattattacctcaaaaccataccgagtgtttatcgcatcctctttgcgcgccagatggcgcgctttttcattttacttcttcacccaattgccattaataccaagcacatattcacctgccccggcacggttcaccaatttttcacccgccattttagcaacctgattcgttgtcatattattttgaacggcaattgcagcatatttcttttcccgctcctcgttgaccttttggatcacggactgagcatccctggtcttcttcacgggtgccaaatagccactgaacgtttctcctaccagcccttgctgttttgcttcactcaacgtcatgcctacagcaaaagaactgaatagcagactcgccagaaatattactcctgcttttttcatattctggcccttaaaataagttggagttgtttttgagcatatcttcaatttgcctatcgactttaatatgaatttcatgctcaatcttcacattcatatcgatcttgatcggtttatctggcgtcgctacctccagcctgatgcaccccgtcaaaactatgctggccaacatcaggctagccatgcccaccgacaacctgagtccagtttttgttatcatttgtcactcccgttcattacagatatatttttctgtaaccactcttccagattactgccaaagcgcagactacgccataactgaaaaatgttctcctcatggcgatagttaagcctgacttctcgttttttatccaccataggattgacaccgctgatttctgaattcagtatcaaaatgcccaaattatccagcgtaacatgtgcctttaaatggctgatctccaaataactcagccaatccattgtcatacctgccgtcaggtcatttttccctattgagccaaccgtatctttatctaacctcaatgtcagagatccatcattggatacccagccctgctgaataatccaatttttatcattcaataatagcggcaattccccgctgattctgcccgacatggctatttgcttaactttcagaacaccgaacaatttactcagatttaatttatcaaatcgcagtaccgcagcctgtttttggggtaattgaagtttatccagcccaagcttaccatccagcatgtccacattcacattggataacgtcaatggctgggtttcagtgggtgggtagaaacccagcaaatcggctgtcacattctgcataccaaacaagcctttaatttcattgaccctgagttggacaggtgatatgacccccaactgccaagtatgttcctgcaaacgccacggcaaaacaaaattcaagccgtcaatttcaccatcctttagccaaacactcgcatttttcactacccaatgaccaccggcacgtaatccctgccccttcgcagccgaaaatgccgcttgggcatagaggtttccaccacgtaccgtcatccccaaatctccggggatcaagggctgaagtgccaacagagattgactcggccagcgagcatctcctcgcaatcgcgtaccgtcccagcggccataaaatgggattggctcaatacctttgggagataatttcccattcaggataaaattatccggtgactgacctgtcactgtcgccttgaagtcgaaaggaggtaagaaaccgccagaacggaaatctgttcttaaggcggataactgcaagtcccccatgaatgtcggttgagttgcggaacgttcccacaccagcggcttgataagctgcaaacgcggtgcctccatctgcacaaggccgtattggataacatcaaaacccgtgtttaacgcattcaccgttatctgtgaacgctcccagcttcctgtgcctgcaatatcccatttagcttgcagcggagctaaatgtccattgccccaataacgccaccgccaatttccctgatcgggtataaaatcctcggcatccccatcaagatgcagtttgaattttccccaatagttatcctgtgcagtcacgatggcttgcagacgacccgtaaaaccatcacgggtcagataagtccccgccaatggtaaacgcgcttccttaaccgtaaaggtctcgcttacttttccccacgcgcgaaacagcgcgcccggctgaaatgtgattttaggtgccaccagcggacccgtcacaatagcgggcaatgacatcgtcatgaccatctgcccgcggttcatttgtccggttaactgaaatgggatatgggcattcgccatattgatgagtgtcggttttatagaaagaacgatattgcccctgcctcgttcattttgggtgatcaaattcactcgcccactgattagcatgccatctacaccttttctccagtgatcaaaggtcaaattcacgcctcctgacagtggctgccccgtatccatccattgccatttaccatcagttatcagaaattgagattgattgaatgaccatggcaactctgccaatatccgcttttgcttctcttccctaatagtgagcgttcctccctgcccctgccattttaatattacctgcaaaggatcaggatattgactgatggatagccgccctgttatctgaccttgtacgggtagtgcgtcaatacccaatggcaatgagatatccccattcaggctgatttcctgctcaggtaatttcacgaagaattggtgaataactaatgtctttttatctgccgtatgaacattcagctttaattgcttgccttgataggaaaatgtctgcccttgacgtgatgaatcaaattggagttttccggcaaattcctgccacggcgtgagctcaaagtgatcaacgacaagtttaaccgcagaaatggaggataatgtatcctcaatcgataatggttctgaagggttttctgtcactggcaactgccccagacacgggctattgctgtgaacactagcagcatgaatattccagtagcgctctttggttttttctctgcgtgggtatcccacaaacagcccggacatattgacccattcacaaccttttgcctgcaatgccaaatcatccagccgtaatgtattcttttcccattttggttgactgagagaaagagtaacgccctgtggcagccaatgactgacaatcaatggcagccaacatggaagtgtgtaccaacccgtcaacaccaataacaccagcagtgttatcatcaccgcaaacactttgaatatcttggtcattacatccttatctcttatttttaatctaagcacaacatcctgttatgatagtttcatatcaggctctaagctggtttattatacgggctattatcatgaatagcttattagtcggtttgttcgaatatagcgagagataacgcttagaacctatctcagtaaacgtcattattgccagcagttaaaacgcagcaaagtgaatgcaacaaatggttcgaatgaacgatgaaattaaaaattccacagtcaatatatgacggagacgagacgatgaaattggttgtttatagtacaaaacaatatgaccgtaaacatttagaaatgctcaaccaaagacttgggcttgattaccatatcgaattctttgatttttccttaagcccacacacggccaaaaatgccattggtgcagatgccatctgtattttcgtcaatgatgacggtggacgtgaagtgctggaagaattggcagcaatgaacatcaaaattttggcgttgcgttgtgcgggattcaataatgtcgatctggatgcggccaaagagctaggcattcaagtcgtccgcgtcccggcttattcacctgaatctgttgctgaacacgcggttggattgatgctgtgtttgaatcggcgtattcaccgagcctaccagcgtacccgcgatgccaatttctctctggaagggctgactggcttcaacatgtataaacgcacagccggtattatcggtacggggaaaatcggtctggctatactgagaattttgaaaggttttggtatgcgtttgctggcacatgatccctacccaaatcaggaagtgttagagcttggcgtgaaatatgtagatttagataccttgtacgccgaatctgacgtgatttctcttcactgtcctatgacgccagaaaaccatcacttactggatgaaacagcatttaataagatgaaagatggcgtgatgatcatcaataccagccgaggggcgctaatcgattcaattgctgctattaacgctttgaaacagcagaaaattggcgcattgggtatggatgtatatgaaaacgagcgtgacttgttttttgaagataaatcgaatgatgttatccaagatgatatttttcgccgcctgtcttcctgccataatgtgttgttcacaggccatcaagcatttttgacagaagaagcgttaaccagtatcagtgaaacgactttacaaaatatccagcaattaacctccggcaaaccttgcccgaatcttgttgggtgatttttacgcacatcaggagataaaatgaagaaagcgatttcgtttgcgatcgcgaccctgctactcacagcatgtcaatcttcgggagttagcgccacggggaatgttacggtcagggatctgcaacatcgtaattttgctttaatcagtgtcaatggtgcaactgtttcgaataaagaagacagtaaactttctattgcatttggtgaaaaaatgtttgtttcagcaactatgtgcaatcattttatgggagtgggtaaattaaagcagcgtgttctgactgtcagtattttagaaaaatcccagatgttttgtgtcaatgaacagctccatcaatgggatcaagtgatttatgatgtactgactgagggagccacggtcagattaaaaagcaaacagcttacattaactaatgacaaaaacacgctggtttatgttttgagggatattacccaataatttaatcatgtaacgttattttttctcattctgagcatattttcaccaaaacgatttgtgattacccagtaccatactgggtaatcagctcaacccgcatttcagcttgttgtccatttgatagccattttcctcaaatcaatctcctgaaatagaaacgaggtcacatattcatgttgttcttatcttttatgacaacatcacaccaatcatcagcattaaagcaatccataatcccacaaattttatataaaccagccattcactattcattttttcacctctcattatcaaacagacttgcatagctgcatgagataatctctgatggtctgacttcaaatcctcaccaacagtaccccatatatatttggtaagtcgtgtgaatgccattctattatttattacaattgatatgatcttggctgaattgtggcagaaatagaacaatgttcacttgaacaattggggttaattattgaacaataaaacacttgatttgattcagccggctcctgtatcgggatacaatgctgcactccaattgctgtaaatacagacgaatatcgacggttctttgcttgaaaaaggggtcgcgattgatttgattttttccgctaattgaagggattctagcgatgagttaccaatataagttccactgggaagacgatgccattttccattaggaaattgtatcgatttattgaacttatttgctgtcattctgttatgcaacttctcatagccatcagaacccgtgccataaagttccacacgaaccaaataacttgccatttatcattccttgtattgactgtggagcagacaagttatcagtttttcttggctgataaaagcaagaaaaacgagaggaaaatccgatattcatggcaatccggtgtgtggtgatatccggtatgcgcatacataattggtctcaaacaataatttgagaccaattttttatgtctgactcatcccgtgaattacaagtcattgcgaagtttaaccaccctgaatccacagacacctttcgtaaaaatattcctatcgaatggataaccattttgagaaaatagagagttatcatcacataatatttattacggctacagtgctaataaccaaaaaaacataaaacaaaaatcattttatattaataatttaatgcatcaaaaagccgttgcttcaataatgcaatatcatccgcattgttcttatttaatagattaagattagctatattactctccagagtttcaattttattttctaattgcttatttttttcatccaacaatacattagttttagccaattcagaatataattgatgaccattaaccgcctcagtactatgatttgaaatatcaccagcagcaacatgcacgatcttacgttcatgaccagattttcctacagaaataacattcggtttgttcgcaatggaatctgcgcctaatgcaacgctccctttttctgttgcagaggaattttgaccaatcgctatggcctgagatgcactggcagttaccttttgccccaaagcgatggaagccaggccattggatacagaatcagcaccaattgcaattggaaaaacaacgttcgcatctccctgtttaccggcaagttgattttgcccaatagcaatagccgcttcactgatggctttagaatttcgtggtgaagcaccaattgcgacagcatgtactgccgatgcttccgcatgtccaagtacaactgaatctttaccaattttttgctcattgatattgatattgatattttcaatagacatattatacctcttaatttataagttaagtaatcactctttattaaaaatcaataaaatattaaaaatagactgacattaaatgttgttaattaataccaaacttcataataaaaaataatgaaatatatttacctataacattatataaaaattaaatattgtaaataattaaaataattgggtatatataatatattttacgaggtttatttaatgtattgttaatctttatgaaagatatatcttataatcctcatcttaatttattagctataccaatggatttcgatttgtagtacgacggcaagagaacgaatccacaggagtatagctaactatgtgacaggatttatttctaatgccccacagatgcccaaaacacagccatatgatataaagtccctttcatatcaataagtaatataactactctggtttgttcataatatgatcttcccagtccaccacatcagcctcacgcacagcaatgtgtctgacagaaatacgctctgcatgcatagctgattttgaaccactgactaatgggtgccaaggaaggagtttttttccttcaccaatcaaacgataagcacaagtcattggtagccattcaaacgtaaccatattctcacgcgtcaatttgatacaatcaggctcatatctaaaacgatcttcataattcttgcactggcaggttttgatattcaattgattacaggcaacattggtgaagtagattgcatcagtatcttcatccattagcttatgcagacagcactgaccgcagccatcacataatgcttcccactcttggtctgtcatctgttccagagttttcccctgccagaaaggttgagacataagttcagtcattcctcattgttaaatcactctggttgttaaaacgtgctcattaagagagacgttcagtacatcaccaggttgtagtggccctacaccttcaggcgttcccgttaagataatatcaccggggcgcagggtaaaaaaacgcgacatatagctaatcaatgggatgatgggcattcgcatgtcactcgtattgccgttttggcgtgattcgccatttactgtcagggaaagctgagcattttgtggttcactcaaggctttgacaggaataaagcccgatatggggcatgaaccatcaaacgccttactcttttcccacggttgcccagactgcttgaatttatgctgcaaatcacgcaatgtcagatccagtgctaccgcaaaacctgcgatcgccttgccgacccgttcctcactggcattcttgagtgtcgaaccaatcaagaccgccagttcaatttcatggtgcacagctcccaatccctgtgggatggaaaccgattgacagagatcacaaagagccgtttcaggcttgagaaatataaccggctcttcggtcactttagagcccatctctttcatatgcctctcgtaattactgccgacacaaaccactttactggcaggaaaatccagcagtacgccctgccagtctcgatgctggtacatagcattcctccttatctgtcttcaacagcagattctcagtgagtgaggaaatgggttttctgaccaatactctctgccatcatacccacactaagagcaaaattgtaagaacgattccagtgcatgatagtacgaaaattctgcgttacccaaaatgctcgctgttcagtatcattcggtatcacaatccagcctttggtattcactggcagactggcaaaatcgggagatgaaacacccaacgcctgccattgggcaatagttttcccctgctctaacttaataccttccaagttttgattaaaaccagcaggcagtgaaaccccataaccccacggtaacccttgttgccaaccttccttcgccagataattggcaattgaggcaaatacatcttccttactgttccagatatcgattttgccatcgccattaccgtcagcagcataagtcaagtacgaggtcggcataaactggctttgccccatcgctcccgcccaggaacctttcaaagtttgattttcatcaatatatttcttttctatgatttcaagtgctgccattaattgttttataaaaagatcttcccgacgaccttcaaaagcaagtgtagataatgccgaaatgacatcttcttttccctgaactttgccaaaaccgctttccaaaccccacaaagcaacaatatagtctttcgatacaccatatttgcggctgattctctctaactggggcaggttattctgatactggatgacgccctgctcaatcttccgggctgacaggacacggttaaggtaatcatccaacgtgattttcttttccggctgattacgatcagattgaataacccgcgagataaaatgaatatcggcaaatgcacgatcccgtgttttttcactgaaacccttctctctagcctgttgtttcagtaaaaccacataggcgggaaattgcgatggttcacgagaggcaattggaaattgttcatccaatgccctgatttctttctgtatcacaacagcctgtctggattgatcctgcaacacttttccattcgatgaagtacaccctgccaacagtgtcgctgtcaataaggtcacaccagagattaatttcatgaatcaattcctcacttcaggatcaaacacttgctaattatttctgccattacttatttacagccagatgttcactcatcagactttccactggtggtggcacttgcaggtaaaaaccctgctcacttagcatagttcttacttttacaatatctgcattagcaagtttttttcttcctgataatgaaatcatcatggagtattggggttcaccgaatgttttcagcaacgcttcagggatgcgtgagaaatcaccttttttttcgacatagagaaatgtctggtcacgttttgggcttctgtagattacacaaatcattgtcataaactcttttaaattaacactgcgacttgcttgaataattcagtaactataacatgcttattatatttaagaataacgcatcccagattctggggaacttaaccttgctgagtcaaaatatcgatgtcacagtcgccaattgagctaaaaggcagtaattttacgctttcggtcgttcatttgcatgatggccagccggaagtcattcaaagggctatgcaggaaaaaatggagcaagcaccagaattcctcaaaaatgcccccgtcgtaatcaatatatctgatcttccagccggtgccgatctcctcgcactctatcgtgctgttgaatctgtcgggttgcgcattgttggcatcagcggctgtcaggatgaagaacaacgaaaaattgttctaaaatctgggctacctttactgaaagaaggtaaaagtcagaaaattcctactcaagaaaataaaccgactgaacctattttcaaaaaaactcgtataattaatacgccggttcgatcaggacaaagaatttatgcgccaaatagcgatcttattgtcaccagtaatgtcagcgctggcgcagaattaatcgctgatggaaatattcttatatatggtgtgctacgtggacgagtattggcaggcgcatctggtgataaagaaagccagattttctgcacccatttaaacgctgaactctgctctattgcaggtcaatattggctcagcgaaaacattccagaaaattttgttggcaaggctgcaaaattacgtttggtaaataatgaattaactattgaaaccttagtctagcccttataacaaggaatcgcttcatggcacgcattattgttgttacatctggtaaaggtggcgttggcaaaaccacttcaagcgcggccattgctaccggtctcgcccaaagtgggaagaaaaccgtagttatcgattttgatatcggtctacgaaatctcgatctgattatgggctgtgaacgccgcgtggtttttgacttcgtgaatgttattcaaggtgatgccgcattaaatcaagcgcttattaaagataaacgtaccgagaatctgtatattctgcccgcttctcaaacccgtgacaaagaagccctcacccgtgaaggcgtcgaaaaaattctgaatgagttggatcaacaagggttcgagtttattatctgtgattcaccagcaggtattgaaagcggtgcattaatggcgctctattttgccgatgaagcaattatcacgacaaacccggaagtttcatctgttcgtgattctgatcgtatcttaggtattctggcctccaaatcacgccgcgcagaaaaagctaatgagccgattaaagagcatctcctactgactcgttataatccggggcgtgtgaaccggggcgatatgctcagtatggaagacgtgctggaaattctgtgtatccctttgcttggtgttatcccggaagatcaatctgttctgcgttcatcgaaccaaggggaaccggtcattctggataaagaatctgatgcgggtaaagcatacgaagataccgttttacgtttactcggtgaagaacggcctttccgttttatcgaagaagaaaaaaagggctttttaaaacgcctgtttggggggtaaagcatggctttgttagatttcttcctgtcgagaaaaaaaccgacagccaatattgccaaggagcggctgcaaatcatcgtggcagagcgtcggcgcggtgattccgagcctgcttatttgcccgaaatgaaacgggatattctggccgttatatgtaaatatgtacaaatcgacccagaaatgctctctgtgcagtttgaacaaaaagatgatgatatatccgtactggaactcaatgtaacattaccggagactgaggaattgccaaaataacactatcaaatggcgttatttaatttaaacaggtgatttctcaataatgaatcggggtgtcctaacatcccgatttcaaatattcaacaaatctatcaatgcctttttctcatttttctccaattctcgtcatcccccgattttggcaatcaccctctccatatttattatatgattaacgaatgataggcactaatcctattaatatcagataccgtctcagtcattaaactgcaagcggtatttctgcgttaaataatgtgcctgatttcatcacgccataggctaatcgtaagagtttacgcatcactgcacaaacaccgactttcccccctttatggcgtgctgtcagctgttcccactgctttttcactactttattgcaactgatcgctgccagcccaggcatataaagtgcttttcgcagctcggcacttccctgcttcgagagatgagcccgcccttttagttgtcctgattcatgtaatttaggattaagcccagcgtaagccaccacttgcccactatgatgaaaccgtgaaccatcaccaatataagccagcagtgttgcgctcaaccgttcgccaataccgggaatactttccagtaaccccttatttttcttcagcgaaggcgagtcatcaatgtgcttttttagtttcaattcggtgtctttgagttcttgctttagcagggtgattatctttgcatgagaatcacaaacaacttcatccgccacggagaggcgattctcttccgtcaaaagcatttcattcagcttattgcgatggcggactaaagccagtaattggcgttcacaaagcggagcgggctgccatgccggaggatgctgactggcgcaataacgtgctatcagtttggcgtcaattttatcggttttattgcggagtaattccgctttaccaaaggcatggatttgtaccggattgacaacactgataagaagcccaagggttacgcatgaaattttagtcggctaaaattgattaaataacagtgcttccatataaccgttatcccatcccgctgattttcttcgcgcactcaaactcaatttactattgatatctcgtttaacaatattgagtgccattttacgtaattgggcaaatattcttgtggcgacccgctctctcatccgtgaatcatcttctcggaaagtgacatccagtacccagtgtaaactattttcgatagcccaatgttttcgtattgcacctaactgaaaggcgggagaatcatgacaactgcttaaataataacgaaagtcagaagtcaccgtgtcagaatagtgttcttgtcgtatcgtttctgttaccagaagagcttgaatatctggccaagaccttaagtgttttgtttctgatgtcagtggcagaacccatccgcgccgtctgacggtacgtccgtggctatcatcgaattcatcatggtcaggtttaaggtaaggtttttgggttatctgttgttgttgaaaatagttaaccgcttccgaaaaggttttcccctgattgcctttaagcgacaaaatataatcggcttcactctcgcgtagttgctgagcaatcgtgcgttggcaacccatcgcatccatcgtcacgagatggcctttcaatgaaagcatcgataataatgccggaatggccttaatttcgtttgattttccgtctacggcacattgacataagctaagccctttctcaaccgtgaatgcactcaccatatgtaatgcgctttggtcaattttcttatcaaacgaatgacgtaaacttttaccatcaatcgcaatgatagcccgtttttctgaagagaggtcacgagaaacccattgataaaaatgatgttcaaagaggctcgggtttaataaactgaaacagcgccggaaagtatcatgtgacggaataccccctttgagcggaagaaatgaactcagccaatcctttttgagttgaccgtactgttcaatatcagtccaggcgttagccccagcaatgacagcgcataccgcgatcactaagatatcaataacacggtgtttgacctttccctgacaacgtgggtctggaaaatcagaaaagacatccactaattctttcattagcgtccctctaaaaatgaaagaattatccactaaatattttcatgcgtaacccctgagaagataacgtagtcgtcgtgccaactcgtgaatatgttaaaggcgcgatagcagaacacgcccagagccgtaaccacccatacgcaactcaggtagagccgggatttgtgacactaagtaatgatgttgatagcgacagtgaaaagactgtggcaacatccaaagcggtgaaagcagcgtatgatttagccaatacagccaaccaaaacgccctcaataataactcaaatctctatttagagaagaagctgaatggggcagatatcccggataaagcggagtttgtgaagaatcttggtttatctgaattagtttatagagccatagggaatgggccaaaccaagtgccggacataaacagttttgattcttgttataactggtagttatgttataggtggtgattggggacaaggtatatctgctgaaattagatctaaagaagagtttttaattgttattcacgactcgcttggaaattggtcaggttcacgagtgcaatatatagctatcggatattagccttatagagatgcattccttttgctatacatgaataaatataacattgattcgtattcatgtttttatgacagtgtatatcttcaaatatcactactatcgatcacataccaatctagacatggatgtctaaccaatatccttcggaatttcataggctcctgtagcgcggcggccaattccgcactaataggcgatatattctgcactcattaacaccgagtttatagctctataatgcacagtgcagaatgaaacgcttagtactactacggaaataatttcacgccgccatgtctcgttgttcctacaatccggatcgattttaccccaaaagctgagccgctattctatcgctgtcttttcaatacatataaggtaaaaaaatgagtgaattaatggcaaaagaaggcacctatgcatgtgcgctgctgcaactgcaagacggcaagcgcgtcagcagaaaagaatgggcagtcagaaggaatgcctgttgcgtcatcccggactagcagaccaagtggtcaacatcggggattatccggcacaggctggggtgaaagtgggtacccgcttaaattacttgccttaccttgaacgccatacggcatcgaggaatgtgatgccctggctggcctcatcggctgacctagaagcgctggactgggaagtgattgtcaagacaccagaaatccataagcaagttgaatatagactggttttggacaagtacacgtgttcatcgagccgcaatgcagaccctgaatatgaaaaatggacagtctctgaacctcatcagtccatgttgattgacagtaacctcgattttaacgttccacgttttgactgggtggataaccatgccgccaaacccaatgaatttagtgttcattttagcaatcaatcgcctgaggcccgcgaaaaattgagcgctatcaccgataaaaaactgactattaccgtaaaggggatcgaatatccgctggggcaccacacacccgactcagattatcaccatcctcgctatcaaggcagtgaggctgaaaaaatcggcgggctggtgaaggcacagtttggcactcttcgtttccactttaaatggcatgactgatgtgatgttaaaagcggtgtcaggggcgttttcgcccctgacctgactttatgttggttgttccggccatttgacatcgggtgcggtagtgcaatctacccgattgagcagcacccggtatttacgccattcggttaatgcggatttctcggcacccgttgccatctccaactcaaccgcatcctgtaacggtgcgatagcgtttgatgcctgtgacatcaggtattgttttttccgctctgcccgttgctgttgttcctctggtgttggcggcggaatatcgccccacgcaggcagaccattctcacccactacgcgacgcttgccttctggtggcctgcttgccacaaactccagataaacactctcgccaacctcgataccgtccgcaggccattttcccacattgaggtagtcctgctttaggacttccgggtaaaacatattattttttgcacaatatacatacatgattaaatccccactgcccaccagaaaatatacgacctatcatcgggcgcacccgccgactggtcacaggtaatgattgcgcgtttaccatcattgagattgaaaaaataggcgctggaattactgctgctcgcgtggggatacgatggcgatgccagtccgccaaaacaccgacggggaaactctgtcgaaaatgtaatcgtctcagaggattcagccagcgttttctctgtataaccccattggaaaattaccccggtatccccgcatttccaccacccgttttgatccaatttcgcgtcatttttatacccaaaccggttattcgattcggttacggtatagagttcgcttttcttgtataggtcatcttttgtatacagttctgattttttgtatagctcctcaataatggccactgttccactttttgccggatgccgcagtgtgtaatttcgttctccctcatatgcttgccacattactgcacccttgactatttccagataggttcggtcggcaccgggtaatcctgaaataatagttttagcatagacatcactgttaaaaatctgtggtgtccattccgtcagagaggcggcatttttcgcccgctccacggtatctgccaaaccgaggtttttcacaaactcattttcgttcggaatgtccgcgccgttctttgatttctccagacgagaattagcattgttattcgcattggccgcattttggatggcggtgttcgcgttgttgatagcgtttccggcattctgatttgcggtattagccagatcatacgttgctttaaccgctctcggtgttgcagcatccacctcactgttactgttagtggcgttagacagtttagtaatgcctgccagagtctgagatgccacggggatattagcgcctaccgttgccctcaatgcgtttagcagccctgctcgtaacgcttccgtgttaccatcatccaatacgtcctgcttgttggtctcagcgataaactgagccaccacgctcgcgattaccgaagcctgccgccaaactttgtttagctcctgcgacttagccacaccagaactaaacccgttagtccgtgcggccagattgccgtactcctcgtttgttaatatactcgccccgtctgcgatgccgaacgggagaaattcattttttgccatagtgtcctcacagttttacagcccagccgcccgtaccaaaaccggcgacaaattcattattgatatcaaagccaaacagccccttgcgggcagaattgatatagttgttaacccgaaccgcctcaggtttgacgttcagatagccttgcctgatcactgccttaatcacctcaagaacgacgccaccggttaaaaacacatccatcgtcatgtcctgattatcgataaacaatattttggtattactgtccggcaagatttgctgataaatggcctccagcatttcgctggtgccgtcccagtggttagcctgaatttttacccgtaacagtgtgcgatacgtctcatcgtccagttccgtaaatccggtgtcactgtcaaatttcctcttccagctaccccgatcgaaaccgatttcctccatgtccagcgagaaatacacgccaacaataggtacccgcacgtagcgcgacagcccaatccattccccgactgcatccaattgcacaccgaccccgtggtcgatggagaattcggtattcagggtctgggcaactgtggcaatgtctgagagcgtgcgggtgatgaggtcaaggtggtcaacaaatttaggcgctgtccgatgctgggcggtaatgagttttagatagtctcgcctcatgtcaccaccacattaatgttgtcaatgttacaaacgggtgcctcgttaaaggcgatttttaaattggattccgccagcgcatgggctgatcggccgattttcaatgtgttaatgtcgtaggtcttcccttcttcatcgccgggcaggttggcaggggaatagagccgcgccagataaacattatcgccaataacaatcgtattaatgtatttcgcgatggccgttttgatcctgtcccctaccagcgtggtgtagccctcaaaagccgtaatactcagctcgacataaacaggcacgtcaacgggacgcgagaaccggactggagttgacaatccataatggttgcgaacattaatcgttgtgtcgccgaacgtccctgagccgggcgtttttttcagggcaatggttttagcgatttcagtcgcgtccccgccatcgacgatcatggcaaccgagtgcggcgggataccgttgacgtcagttttatgggtatcattctcaaatccacgcagacgaacaacacccggtatcaaactgattgcgccgtgcatgccatcaagtaccgttcgcgatggcagtgcgaccgatttatgttggcggatgcgtaacgcgccgtccggttcaatgggcgcgcccgccgtggcgctatacgaattagtgacactctgccagccccgtgtcggtgtgccgattatataaatgtcgcccggtgcggcggtgatcgcccccagtttttgacaggtcgccgtgacggttactgtaccctgcgtacctatcgtgacaatatctggcaacgtccacggatggttgttccggtcacgcacgagaccgtttttaaccaccgtgccgacctgacccaccagagtaatatcggccgtcgagcgagtagctgcatggcgtgacaagccattaatggcgacgttgttagagagtgcggcaccgctggacgtacggggactgtaggtgttataggacgcaacgaccatgttattggcatcatggattgccagagcgtaaatggcgatcatctgcccgtctttactgtccggctctaaataggcatcctcgccgtaaatctgacgaaaatacccgttgagccgttccagtatcgtcgggtaatcaggcgcagtgatgccgctcgcggtgattttggccgcaagccctaaggtgtctagattaagcataatttaccgttcgctggttactgtggttttgccgtagcgggtgttgatagtggcggtgagggtcatttttcgggtgtcgggatcacgtttagcatcgagtgagataatttcagttaccccctcagtaccgagaatgtgctcgcgaattgccatcgcactggcatagcttttatctaatactgcctctcggtagggtgttcccgctgccgtatccagaaaccagtccccacgccataagttgagccgtgtttttacggcctgtgcgactgcttcgggtgagttggtcagaaaggtactatcaccctgcccgaaactgtaatcgccgttgctgtcttctcgtcggtatcgcattattgaggtcctcctgtagttccgccgcctgtttcaactccactatgtttgtgtttcatctgactaacgccacccgctatcacatcatttttcacattaatagggccattcatcatcgccataccaccactggcacccataccctgtgacagattgccgttgatgatcacattgccattgagcacaatctcgggtgaagtgatttcagttccgccatccgccgttgcggtcagtttgccgggcgttttgaccgtaatgttatgactgccgggagacagttcgatgtaggccgcgccgtcgtcagttcgcagttgggcggcgctggtactgataccactgattttctttgcctgagactgaggccccacaatcgcaaacccatctgataaattatgctgacgagggtctacaggttcctgaacaccgccgctctgccaccagtaatcaatacaacggtcagcgaaaacgaccagacattcatcaccggctttaacaggaaatgtcagtgtgacaccgcctccacgcgggaaaataaccggcacgtccaccagcaaaggtaatgctactgattctgtcttgccttcgctgttcgtgactttccagcgtatcgcaggctgtgcagtcactgtcaccgcatcggcattaaatgactgaataatgcagggtaaggccacgtatagcccggaactgatcgccgtctgcatgactagaaacggcgtttcgggctggttaactcgttcatggtgagtgatcattgttgtctcacatctgcctgtagtgctgattggttaattaatgtctggtcgctcttggctacacagatcaattccatgtaccacgtgttttcacgggtatcaccgaaatagttgacgttgataaccacgtagtcaccatcggcgtcaatgggcgtaggcatctctttatcactgttgccagaggcgataacccccgtagatttaccacctcgggttcatcatggtaccggatggccttacggaaaaatcgaagggctgccgcggcatctcgtttggtggtcaataggaagtcgatggtctgaccgttgctgtcaaccgcccggtacagatatttccactgtcctttgatttttatgtcggtttcatccattcgccatcaacgacccacggtgcgcttatgtcggcgaaaggccttatccagcaacggtatcaggcgaatgacccagcggtgaagcgtggaatggtcaacgacaacgccgctctctgccattatttcttccaagttacgcaggctgagggcataagcgagataccaacgaacgcactgagcgatgatatcgacaggataatgtagacgtttgaaggcttttcggatcagaggcatagtcaggtaacatctcaaaaaaaacagcatgttacccaacgacgccttaatgcgacagagcctgaaaaagcgtgggtcacttgagttgtttggcggtaaaatggaacggtaaagaagggacaatatcgttactttaaacagttacccatcttggttttgcgaagactgattattgatgacatgaacggcctgacggcctgatgaaaaacctaagcataaaaatggctcattgaaaccgaacattttttaggcgcatcaggcgcggaactcattagggcgcgggcatttttgctcatataacgccggatagatttaagcaaatccatcataaatcaaaatgggtgttgcaccatagattttatgctctcgagcacagaccgtgttggctgggattgaacgggtttgtatgttgcgcaaaggacaatatccgcaagaaccagaatatccaatttcatcggcggcctatttctatcaactgactgcttaaaaataaatcaagacactttcgctcgagatctctctgttaatgcgacagaacctactctggttctggtaccgtgccatcattggcgagatagccatagcggttaataaattcccaggcataggcttcaccgctgcggctgaagccggcatcccagttcactgaccaggtcatcaggccgagaatgtccagacccgccgctttcagtcgtgccagcgcgttatacacatcctgcggatcgataacgtagccagtggctgctgcatcattattggctggcaggcctataataaatttaccgtgaggaatttttataaaaccacggataccggtgaccaagctctcggtcaggtaataaaggaagtcttctttctgtgcatcattattctgggcaatccagccgacgccatctacgtaaacgccgtcgccgccctgattataaaattgcggggcgatgtaatcgtagtagccttccagtccgttaatataggcgttgtactcacgcccctgcgccagatacgggaattccggggccatactgatggtgaagtttttacccaacggacgaaaatggttcttaactactttcagtgcagcaggaataacggtctgattgttagcagcagtaatggcagcctgctctaggtcaatatccaggccgtcaaaatcgtactgttcagtcagcgcgatgatacgatttgccagcgccacttcgtccccgctgatcagctcaatatgtgcatccgcaccaccgagggaaataagcactttacgaccctgagcgtgaaccagatcgatctgacggcggaactcagtttcagtacctttataaggtttgaaatcaggaatacggtcgctgttctccagtaccttcataaaggcaacggcaataacgttatacgccacggggatttctgacaggtccatttcagtaaaacgcccttgcttataaccctggcccggctccggtgcccaattgtgccagaagcccatcacaatcttattttcactattctgtagtgtaggtgttttcatggacataaccactccatttgtattttcggatagatagtggatactgttaactccaccgttttacggcaacatttttaaacttgaatgaaaaaatcaggggatttaacaaggatatttcatgaatacgatagtcagtgttgcgattgtcgggatggcgaataaactggcccgcacggtctggacactggttgcccatcaacgggaataccaaaaaaattacgtcagtgtcaggccttattgaagtatttcacaggtaaaaatttacttcaactcaattaaaaaagaggtatagagctgcaatctaccttcaatgtcacaataacttttgtcttgcaaacgggatgcgttcatatagggaccatagattcctttggcgagaaagatgcctactatagcaactgaccgcccttctgaaaaattgcacttgtatcatagtaattatggtggttagctaccatcataagaaacaaggtgagcctcatattgcacatttaagcgagactttgttaataagcgaaggccccttgtttcaccttccacgccagcaccaatattgaacggtaaccaagagcaacgactctgtatatacaagtgaaattggcgtgatggcatcaaataagaggagggttattatgtattatgtcggaatagatgtcagtaagaataaactggatatttgtttgttatatgatggagttaaaggtaaacgcaaaacaaaatcccttctgaataatgaacatttagcctgtatgttaatagcgtggctagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctgctaaaatccgtgctaagttgtttatgtctgcactcactgcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttgaccatcaagacggtagcttattaggcgaatccaagaaatttaattatttcaaagttggttaatcatattcatcgacattacaattaataccggaacgataattaattagataagaaaatttcactttattagtgtaagcccctaaggatatagttttttgtgggcacgctaccgcccctagaaagtaaacccagtgttcattcatatcttctgatacgatatacgtgattatcaggaacatactgaaattcatatagaaagctaagcaatatataatacatactgaatatttatataaatcaggtgatcatttatttttgtcaaaatgacagctagtaagatatgctctcagaaaactgcatatcaaaaataaaagtagtgaaaaaaataataacaatcaagttggagatataacataatttggttgaagtgaatattttcacaaaaaaaattaacaagtttaattaaattatttaaaaattaggtcatgtattgaatggttagttgttgtgatatttttcagtttttccttgttcatttcgtccaacgccgctttattggcaccgcttttatcaagagttaccccgtcaggttgtccatgttgacgcatcgcctttttgaagaaacgcaatgccgcttttttatcccgatgagctgtcagcaaaaattcaaccgtattaccgtctgagtctatagcacggtagaggtaacgccattgtcctttgattttgatataagtttcatccattcgccaccgacgttcaacttcgggcctgccccgccgataacgtttaacgatcaacgaaacccagcgatgaacccaacgagaaagcgtggaatgatcaaccgcaatcccgcgctcagccatcatttcttccaagttacgcagacttagcgcgtaggtcagatacccgcgaacgcactgagcgatgatatcaacaggataatgcaggcgtttgaacacatttcggatcagggacatcgttctggattcgctaaaaaatagggagcttacctgatgttccgttaatgcgacagaacctctggaagtgttttttttcataagaaataaaacgatcagttttgtatcaatccttctctttcttttctgtcataacttatctacttttgcacacgagtcaaaaaaccttattcagaatgtaatataaactcatttgcctgtcagggttatcagtatccatagcctaatggtttccttaaccgaataccattgtccggcgtacaaccccaacataatgatttataattaaatggctatttaaaatgactgcttaacggcgtttactgttccgttgttcctgaaaccccaaaaacaatttgtgcaactggccaattagatcgaccagttgcttaacactgcctttttcaccaactccagttctatcgcaactgcggtagagcgctacatccggggtataagtactgaatgcgccggaatagatgaaaacgactctaacttctctgtacactcagctggttttatcctgagttcaccttcctctgattccagctcgaaacagctgacatcggggtttaataccgtcagtttgtccatttttctcagtaagtgaattatcttcatcttcttcagcgccggagttcctgtactttcaagcctcatatagcgctgcgccgcctgttcaatactgacaatgcatatactggtgtcttctgatgcctgatgaagcagcactagattttggccactgcgccagagtgacaggttggctatgcaggtatcagaaaaccggatggctgaaccctgaccccgatcatctatcgtgatatgccggtagtgagtcagcgcctcaggggaggaaagccagtaatacaattcttttgaacgtccggtgatggccagccgatcagtgcccgccagttgcggcagacggattttttcccccaaaggaacctgacccacctgcaacaccagactctccggtgttcggttaacaaaacagtaattcccctctaaggtggatttttcttcgctgacttgccacaattctccggtagtctggtcatggacataactggcctcctgcccggcgacctgacccaagtaatgcagaacatgattcgagtcaactatgctggaacgaagcgttttcccttcctccggcaggtaccaagcaggataaccacgctcagaaaacagtctaacggcttgcggtaattcagcctcattcctgagcgccacaatggctgaggcaatttgactgtccgggcgaccctgcacatgccaggcaatcagcaccgggcggtctgtcatcttggcatcagctgacagcagtaagaccgcgccgtccggggtttccagccggagtgtattgccctgacgaaccgcactgcggtattgatggctggcccggagccaagattccgctgcggcaggttcctcagagagcacccgcttttcactcaacttaaggtcaggctccgccgacaggggctgacgatataactgatggttatcggtgtcaaaaatccatgcctgactgccatcctccgctaaaccaagataggtcagagtgtgttctgtaatgagaccaactccgctctgcaccacccggcctgccgtactgtcataccaggcactgattggttttccgttgctatcctgtaaccccagcagcagcagggtgctgaaccgatctggattatcccgcgccagctgactcaatgcggctgtcagaccattctggtgaggttgctgcagccagtctgccgtcaccccgatcagacggatactgccctgatcatccgccagccacagcatccccctactggaaagtgcaaccaactgcttgttcgctatggatacggatctgatatcatcaacagccactttgctggccggagtgccggacaggccattatcctgctgaaaataaagactatgtcgctgatggctgtaaaaataataacccggtttatcaccggtcgtggtgaaaacgcgggtaaaatcagccgtcagggccagcagatccgaatttttctttttcagctcagccaggatgccggcatcctcttgatccggatttatccggttcattctgaccacattccgcagctgttttccatcagtctgtaaccagtaatgtctatccacaccagctactcgcccagaaaggctgatcacctccgccgggctgcctttaacctgacgttccggcgcacagagatcgccggtgaaccactgattcgccgccagtggtgccagaaggccattaaactcaccgtcactggaatcaagggggacaggcagcgcgacaaagtttttttcactgattttatccaggcccgccaacatgaccgtattcccgtcaactgccaccagtttcagtgcttcctctgccacctgataagtatacgagatatagccctcatccagctgccgttccaccacaaaccagagctggtcattgctctgcatcacatggctgctgattttctcctgatcactccccggaaattttatcggcagatattgccgcagaacttcgccactgacaatatccacttgccagagcgtagtatcccgataaaaccacgccttattaccttcaactttcgccagctctgcatagctgagaaaatctgctgcgtcagggacgttagtgtaaatcatacgatcacgaccggtctcatagaatgcacggccgacaggacggctttgcggtgagtgctggtagtgttccactactaaatatggcctgttgtgatgttcagaattgcttaactgcctgagatgatcatgcaacgcctgcaggctgttaaactgcatagcattcgttacgctctctgttatctgccactgattctctttgttctgcttgacagaaaatatccctgcattatttatcagagaaatattatccgacttttcaggcagggttatctttatactgccgatatgcagtagttgtctgttatcttttttgctgaaactggtgttaacattagagccgatatgacgggcatccagtatccagtgggtaccggtgttttcctgtaaggacagagaaaccccctcctgcaagctgatacggtatttgcccttcccgccggtcaattgataggacaggatcccgtagtccttctccggcaactgctgaatgacaatatcccggtcttcatcgtccagaatgatgtcaatcggcgtcgcaacaaattccggctttatacggcgtaccacgcgctctccgggaaaagcataaaaatcaaagtcgaatcgtccgtcttcttccagtcggcgcagaacgtcaaatccccggtcgttgcgggcagtgacgaagggcaggatcatatattcgtaattaatgtaggacttcatggtaactggcaggatcagtatgtcgctgcttctagaacggaaatggaagttgctctgtgcctgtttgtgaccgatgccttcgcggatattaattgcatgctttttatcagtatcagccgccctgccgggccaccagaaaaagtaattactcctacccgagccccatgagtaagtcgggtcattgcgatagagatactggctgtcaaaagtcaggtgaccgtggcgcaaatcgagctgacggatcactgcgccggggatcggttccatcaccgtataacggctgccatctgctgccactttttccgtctgccgatatccaccctgctgataagctgcttccagatcggcaaaataattgcctaccgcttgtgcatcactggctaccctgccgaacgcctcggccagagccgtaaaaccaatacccaaaccagccagtggtaccgccagcgaggaggcaaaaccagcaacaatgggggcaccgaagatcccggcaccaatacccacgccagttgtaaccaggccagcactgtcaaacgccagctgggtaccataaacagccttctgcgattcattctgcgcatgcgccagttctatgccatccagtgccacactgaggatatttaaccccgccccgacaccagtgctgacatgggacagtgatgaaaacaggctgctggtcactccccggccttcactgaccaccgccctgtacaaactggcgagtttagcaccgtcctccagcgtaccatgagccatctgcgccaggttaacataagtgtgcacccgcagtgcggtctctaacgtattgggcatcgtattgggcaccttatcactggctacggtggtgcggtttctatcggcaaaccaagggatcagagtcttaactataaaggcggtattcagtccgtgaacagcatctgcttcggggatacctgtgcgcagggttagtttccctttggtatacgcgtgagttttgctgacagtctcgagatctttatcataagaatgaataaaatcaataatacgtcggtcatccgttatgaatgtctggggaggaagctcagaccgtgccgtattaataaactgtaaagaataacttccgggctgggacaccccctccctgaggctgcccagtactggcagccattcttctgcggacagtgcgtttttactgtacagctgctccgtggcctgctgaaaatcctctgcacggttaagcatctccagcagccggatgtcaatctgcacattgtctggaatcggagccgttttgtttcccagtggcgggttaaccataccccctgcagggaccgatttacctggcgttacggttatctcccatacactattctccggattaaaaacaagcgcggctttattaccgttttctatgagttgtttccggccttcagggctgacagtaatttgagtggtataagccttaacagaaagtggacgaatacgctggtcaagcgactgagcaaactttagcgcatagctttcctgttggtcttcaccagccagtgaacagcttaccatactgatatgttcaggggacgttttaacgccggagtctgtatagaactggctgagttgtgacgccagagcttccggagtacgtttggccagcgtctggtgattaagcttatccccaccatcgcggctatgaccaaccagttgccaacggatttttcctttatccttcaggatagtcaggtcaccatgaaccacctggtattgactctgggcatccagctgcaccagcaccgaatctgtgtgttttcccgctaattttgctgccgcttccctgactacaggatcgttttcaagctgaataatcagctgaccatcaaagcgggacattccaccctcatggtgagcctcaactacaggcttttcccagttactgacaggtttttcatcgaacggagcaatgccctctggttcatgacggtagcgaccttcctcctgatccagcagtgtcggcataaaacgcggtgaatggaacttcttagcctctggcaagccctgattgatgatcggcaagacgcgtgccatcactccgtcatacagttcaccctgcaacgccttctctctgccttcagcgcggtactcgtcaaacatctgtaacatgcccttgccgatactgtctgcactcttcggttcgtaacgcgcagcgacatagaaggtttcaaagaacgagtgatagccgttacggatcatgaaggccgcattggccatctggaagttccagtactccttgacgctcaacgtgtcaccgaacaattccggtaagacattgctgaccgtctgggtggtccctgaaattccgcctacgaacggggtatccagatcattcatgtagagtgtagccttattctcgggatccggacggaattggttgtagctgcggtacttatcgtccttgatcaggttcgaaccatcgtgatatacctgctcctcagggctggtattgaggatcagaaacgggtctggctgattcagccggttattgattatgaccttgttgtcacctctttccgacatcagctcagcatggggatttaccgggactgcaagcttggaaaagctatcggctaccgggcgcaagacatggaacaagacctgtttgcgcaggctcctgccctcattgctcaacagagctgccttaacggccggatacaattgctcatcggttctctcaaagttctcggggccgaccaacaacaaggcgagtagctttctgtccagcgagcgctcaacctcggtctgattgaagacctgtattttcgggttgtttggatgctgttctgcattagcgcggttgatccgctgggtttcttcttcggtggcccgaatgcgccattgttcgtactgcagtgccagcaatcccttaacttgggcgatgtcactttgcacatagctattttttaagaccttgtccacggttgtggaggagaatactagactattcagtttattcgccagtttagacagtagcgggtcattatcgatgttttcccagaccgaagtggcaaacgcctgttcccacaacaccttgttcaggttattgcccttgatatcgcgcattctgttatcggtgtactccgactccaacacccctgcgggggtgatgtggttgcgttcgagcaaacgcaccagttgctgctcgaacactttgcgttcgctactgccttcaaacaaacgactggccttcgcaccatcgtctcgcaatcgatccagcgtctcgaaaaatgcggcgttgtattgatacaattcggcggtctgtgccttactcaagtgaccactgctgactttgtcgccgtcaacgctcatcaccccaaagggcgttgcggacaggtaggttttgctcgggattttgccctgtggcatttccagcaagtactggcgattgccaaaaccgaccgagcgttccagctcatggatattgatgaaaagcccatcacgatctgggtcataactgttctggcggaaatcctccaagccgatagtctggaagctggtgatatcagcattctggttgatcaggtcactcaaggtgccggccaatggaacctcatgggtgtggccggacaccttaatcccaatttggttcggtaccttgcggtcaacgctgatcaacagtatcttgcgatcgttatccagaaaatgctccttgaagccttcgcgctcggtgctttccgaaaccaggtagttagcgaaatacttctcgacgaattcgattttgaccagtaccgagcgaattggtgcataggtcggagagcgaaaggatggcggctcactcttaagccggtattgttgttgccaggccagggagcgggctggagtaccaaaggaaaagttgaataccccgtccttaggcacgaccagcctgccgtccttcaggaagaagtccttgaagcggccatcggggctggcattaaccagagcgacgttcatgcggatgtagccaggacgttcctccatcattaacagtgaaacatttaccggcaaatcatcagaggccagaggcacttcgatcagcttgctgaaaaccttagcttcttttgtctcttccttagaggatgtctcgagcaaggcaatgtagcgggctttgacatccttgtaggcctgcagcttggaaaacagcctcacgtattttgggctgaacgtggagtcagtcacctgtatagtcagttgctgttccagattcttgatctcggtatccagcttagcctgcttgaccgccgcatcctccctcagagtcatcgcattcaaggtcttggaaccgctgggactgagcatatccaaggcctttttcctagaactgttaaagtgcgttatggccgcctgctggcggctgtataaccggatgtcgcgatccagttgctgcttgtaggccttaatcgccggcgtgtcagatttaccgtccatctgctgccgtctttgctgtagcgtctgcaactggtcgccgacagaaacagggttgtcctgcatctgaaaatgctgagcagccagcacactcagggtactctgctgcatttcttgcagtcgttcgtttacctgcctgatatagtcggcacgcgcgttggcattcatgttgaaccattcggtctgacgacccgccacctcgatctgtcgatcgatcagagtattgagcaattttttgaagtctttcgacatataaaccattacagtaatcctttgtctgtttttgagcgaagctctttgcgtcgcgaaaattagtcagaatatctaaagatatgtaactatgttgataattattatcaaaatgataaccaacatcaattgcgatttaagcaataattacaaatataaatcaattggttgatttatagcaatgatgtttgttatctatttgttttcgtttattttattatctggatatgacgtcaaaggctttataacgatctttgccagttccgatatgacggtatgctatttggaacatttggtatcttcgtcattttcggatagcggaaccgggcatgaaaaaacagatgtagcgctattatgaaatcttatttaattactttggttttgttaagtaatcaagaaaaattaattgcaaatttagcaccataaccttccaatagagtatttagctcatactccacggtatcctgagtccaagtgataaagcgtcgccagtgatatttggcttgtttccagatgatttcaatcagattcagctctgggctgtaggcaggaagataaaataaaagcaggttgtgttctcgtaaccagcgatttctgatttttttctctatcccatgatggatacgcgcattatccaacactaaaaatgtcaggcggttgtccccttgtttggcgacctgctctaaaaaatcaatcacatcagctcgtgtgatactgcctgacggtgcctggtaaaacagcgtgttgtccgtgtaatttaacgcccccagaactgaccgtctgtcatggtgttgaggctcagtttcatggggtttaccccgtggactccatccatattgcaccggcggagaggcggcaaaaccggcttcatcaaaatagaccagacggtagcggcctgcccgtgcaccggccttaatcttatccagcaagacggattttttagcgaactccgtttcatcgcgttttttttaacgacagacgggctcgtttataggtgagcccctgttttttcagtgtctttgccagcgtttcaagcgtgcatggcaaaggaccgtgcttttcctcaacccccagagctattcgggccagcgtcagggattcggaacaggcgatttcaaccgcggttgcgatcatttcaggcgtcatggcgagataccggccgccggcatgaccgcccaatagaccggcaatcccgaagtcatgccaagtgtgaacccagttataaataacccggacactgcatcctgtctcaacggcgatctggcgcggttttaatcctctggccagcatgagtaaaccggttcctctcgtacggatgtcccgatgctgatgattcagggcgagttgttgcaacgtgattcgttcaggctcagaaaggactatcttcgatttcattagtggacgcggtaagtcagtgtattgtattaccgactataacaaaagtgcagataatttcattgattaacttagcgttaatttatttttgcagtttagacataatctatctcatttaatttattgatatttaacataaaaaatcagatttttgcagacaataaaatatatatcatatttttcaaataaaaaataaatattacataaacaacctatacttatataaatataaatataaatataaatataaatataaatataaatataaatataaatataaatataaatataaatataaatataaatataaatataaatataaatataaatataaatataaatattttaggaattttgagatgaatttaaaaatgaaaaataagacaatttattagtaaatatatatgtccaatctcgagtgtaattacccctatcagtagtattttgataggaatttcttcattatttttattacccaccttcatttcttaaataatattaactaattttaattttatgtaaaaatatattaccaattagttgacaaaataaataataaccttattcatcctgattattaataataagaaaattaatgcaaatgacactataatgtaaaataacgataaataaacaaaaaaataaccatataataaaatactaaaaacaattcattttatgatattattttatatattcaaataagttaaatagaaaataactatattaaacaataatcctgtgcgaacggaaggtgtcagttttcgtgtgaatagcgccataaaagctctgtgtttgaaatgggaacacagagcttagctgataatggtgaccttttgcgacaacctctaaagggcgaggtatcctacgcacattcttcttttttttcttctacttgctgcttactttgaatcaaacgaatggcaaaatagagatccggtacgacaatcaaatcttcatcactacgactaagcctgttctgcttgatccagtaatttaattctgttctgcgccccgccagtactaaagtcacatccttttctttcaattccgtaatcagctcatccaacacagcgaaaacgcttacatcatcatgagtaaaactaaccgctgcatctaccaccagccatgtaggatatttcgatgctctctctacatgctgtaatacccgttttttgaaatacccaacattgaagtaagttaaaggcgaattaaagcggtacatcatgatgccatccactgacgctatatcattgccttgattgatagagtggatcatcccttgctcattcacccccaacagttgatcggagggacgaaaaatgatgcgcagaaattgcaatagaccaagcaataccgcaaagccaataccatcaatcacaccaaccagtaaaacggctaccaatgtgaaaatggatagcgtaaaagcccggcggttacgttttcgatatgaccagatattttttaaccccaacaatgaccatgtggagaagatcaaaacaatacccagtgatgacagagggatataccccagaaattctgtcataaacagcagtaccaataatatagtaatggcagcaatgaccgacaccatctgtgttttaccaccaatagcatcattaaccgcagtacggctactggcagcactaacagcaaatcccagtgataatgatgaggcaatattggcaatgcccaatgcccgcagttccaaatccgcatcaacctggtaaccatttttactggcaaagctacgagccgtcatcataaagctgacaaagctgatgaccgcaaggttaatggagggaacaaccaagtcacgcataacaccaagttgaaattcaggcattgggacgatgggcaaaccgctctccatattgccaacgatctggataccatattgattcagctcaaattgccagctcacataggttgaaacgatcatcgctatcagtggtgctggccaacctggatgcagaaaacgcacacctaacaatatcagtaaagtcatcactgacatgcctactgttggccagtgagattccaataatttatgaggaagcgcaattaaccgctcaattaattccggaggtaaacccgaaagtccgaatactttagcaagctgatcagccatgatggtaatcgccacgccattgataaagccttttaaaatagggcgtgacagaaaatcggcaaatgcacccagtcgaaaatggctcgctaaaatacaccagaatccggtcatcagtgtcatgataatggcaagctgccaacgaacatgctcatttcccaaggccagtggggcaactgctgcggcaatcacggcgcatgttgcggcatcaggcccgacaattaactgacgggacgtgccaaataaagcgtaggcaaacatcggtaagatacaggcatacagaccaatgatggcgcttattcccattaactccgcataagcaattgcaacgggtaacgcaaccgcagcaactgagaggcctgaccgtatatcatgactaaaatactctttgcggtaataacaaaaattctccaaccccggcatccagcgatgtaatcttttccacaacatggtatttagtcctttcgtgaatggagcgcattataatgcggtgttaaataaaaactctcaaccctacccgtggcctctcagtttctctgttcgttatggtaaaattagggataaacatgttttttcacctgataaataaaccatttcattgagatctgatacactctggcacaaattcaagaacatgccaccatcggcactacagtggattcaatttatgaaacaacttttagactttttgccattagtcgtttttttcatcgtctacaaaatgtatgacattttttatgcatcaggagcattgatcgcagcaacaggattggccgttgtcatcacctacctgatttaccgcaaagttgagaaatcatctttgatcacttttattgtggttgctatcttcggcacactgacactggcttttcacagtgatttattcattaaatggaaagtgacggtaatttatactatttttgccttagcactgcttatcagccaatggtttatgaaaaaaacgttgattcagaggatgctgggtaaggaactggaattgccggactttatctggaaaaaattgaacatatcttgggcgattttctttattgcctgtgcactggcaaatatttatgtcgctttctggctacctcaggatgtttgggtaaactttaaagtgttcgggttaacggcattgacgctggtttttactgtgttgagtgtggtatatatctaccgtcatctacctcgcgaacaaaaataatgacctccatatggatacctgccgaagcattggcaggtattgttgtattcaccaaataaagcaagttttctaatgacacaacaacaatgcttaccaaacggagaattggtcctccgtacactggccatgcccgctgataccaatgccaatggggatattttcggtggctggctgatgtctcaaatggatattggcggcgcaattctggcaaaagagattgcagaggggcgcgtagtgactgttagcgtagatggcatcagttttctaaaaccagttgcggtaggtgatgtcgtctgctgttatgcccgttgtctaaaaacaggaaattcatctatcacaattcatattgaagtttgggtgaaaaaagtggcatccgaaccggttgggcagcgttatcgtgcaacagatgcagttttcacgtatgtagctgttaataaagataatacttcacgacgtttacccgaaggaaaaactcagttcaaacttgaaagcagtgattcaaaacaatgattcattaggaacgtgaccccataaactaaaggagcgtatttattacgctcctttttatttataaaataaataatccagataataatacattcttacttatttcaaccccctcagataggtattaagaaataattaaaatctacttgctataaaatatgatttctacatgtgcagtcaggggacgctttgcgtccccttgtttttgatgaagatattgattaagactgtgaaataccagtaagcttaaattcaatggttgtcacataccccgttgcaggcgctttttcataacgccattttctcatcgcttgcttcacttcccgctcaaagacgtttttaggatcggcagcaataatttcaatatttttaaccctaccatcttcgtcaatatcatattttaccttaaccattccctctgtacccaattgccacgctcgggatggataaacaggcaccgatctgcttaatgcttttggcccattctgcactttaggtttgtcattaagggcaggatgggttggttttaactgattattccggttattcaccatttgagaagcgtcagaaactggtttgacaggttgttccgatgttttctctacttttctttccatcggcttaggctcctttttaacaacctttttctcttccggttttttctcaggtttaggcagagcaaccttagcgataggttcgggttcaggctctggttcaggtggttcaggaattgattcaggcatggcaggctccgagacaggggcttcttccgctgccagttggatcatagcaacagatatgggagtcgcttctagctgtttttcgggttcaatagcatgaaagagcgccgcagcaatagaaacatgtaaacaaacagaaagtaataccggccagtgtatccaacgcataagagaattcttgattagcagcatgatagtcagttttcggatagctactagtttaaatgcaaatgactatcatattcaatcatgattcaaaaacatctgtatcatgccacacattatagttagagacactccccgctctgcacaaacagaatcgacctgcgacgcctgtcaccattggtcttgcgcaacgaatagatgtgtaaattgcgacgtgattgcccctctaaccagcgacgacggcgacggatgttttggcgaatcattcgccatcgccctacttcattcctgctatgtttcataaaatgtctcgatttaaccctctcattcagctgagtgcagtattcttaatccccactgccagtaatgtcaaccaatggaaggtttaacacaacgctgtattgaatctaagtcattagttaatagatatataattgattcatgatttaactgaatcaaattacataatacctgtgagactacatcaggtatgatattggtaatgttttgattattctctgctaagttgactacatttagctgatggtttgttagggtttccatgaaatggcgacaaaaaatagtatgaaatacttaaataaacaggattgattgccacgtatgacaaccttttattcagtactgaactggctggctattttcttatactggttgattattgccggtatcacaattcgtgttttaatgaaacgtcggcctgtaacatcagcaatgacttgggtacttatcatttatatccttcctttggttggaattgtcgcttatctgtcatttggcgaattgtatctaggcaaacgcagagtcgaacaagccaaacaaatgcgttcatctgtcgctaaatggctctctgaattaagaaaatccccccatatttttgcccatgaaaatagcaaagtagctgaaccgctattccaattatgcgagcggcgccagaggatcaaaggagtcaggggcaataaaatgcaactgatgacttcttatgatcattctctgaaatccatcgttaatgatattgaaaaagccaaccataatatcgaaatggtattttatatatggcaggcaggcgggttagttgatcaggttactggtgccttgatgcgtgccgctaaacgcggtgtcaaatgtcgtatcatggtagattccgccggaagctggcaatttttccgcagcccatatcctgacatcatgcgcaaggcgggtattgaatttgtcgaatcactaaaggttaatatcttccgtctgttcttacgccgcatggatttacgtcaacatagaaaaattattcttatcgataatcatatttcatacactggcagcatgaatatggttgacccgcgctttttcaaacaagatgcaggattcggccaatgggtcgatatcatggtaagaatggaaggcccggtcacaacgaccctggggattatctatgctttcgactgggaaatggaaacaggtcagcgccatcttccgtcaccgcctgacagcactattatgcctttcgagcaagccagtggacatacagctcaggttattgcttctggaccagggtttcctgatgaattgatccagcagtccttaatgacagctatcttttcagccagagaacaacttattcttaccacgccttactttgtacccagtgatgatttaatgcacgcaatttgtaccgctgccatgcgcggcgttgatgtcagcattattcttccaagccagaacaattcatttctcgttcgctgggcaagccgggcattttttatggaattgctagaagctggcgtaaaaatttatcagtttgaagatggtttgttacatactaaaagcgttttggtggatggacaactcagcatggtaggctctgttaatctggatatgcgtagcctgtggctaaattttgaaatcacggttgtgattgatgataagcacttcggcaatgatttaacattcgtccagcagggctatattgctcgctcgactctgcttgataatgaggaatgggcgaaacgcccgctctggcaccgtattcttgaacgtatctgttattttttcagcccacttttgtaacattttgcctaaaagaatatttccattatcatcaatcaatattttccacagccccattagcatcattggggctgtgattagtagtaagggtattcaatcactacagatcatgttttaatttctctttgttattaatttcggacaataccatcatggaaaataaaccaacacattctctccaattagatttcaataatcgaatgactgaggatgaaacgcttgaaaaagcctacgatatctttctggaacaagcgatcaccaatctcgatccggcagatagtctattgtttaatttacaatttgaagaacgaggcggcgctgaattattagaaccctcagcgatatggcttgaacatgttgattttgatttacatcctgatttttttgcagaagttattattggcttggcagaatctgacgatgctgaaattgatgatatctttgcacgagtattaatctgtcgggaaaaatctcacccaatctgccagatcttatggaaaaaataattcacctgaaccgtccttgcctataaataagccctccacaacgagggcttagaagatatactcgtgacagtgtcacactaaacatacactaaagctatagcggatcaaccttaagacaagacacggcatgtttgaagctgccttcaagcaatggacgtgttttggcacattctgcatcagccattgggcaacgggttcgaaatacacaaccagatggtggatcaataggcgaaggcagctctccctccagcaattcgatgcgtttatttcgctctttgtctggatcaggaatgggaacggctgacattaaagcgcgggtataaggatgtaacggattatgataaacctcatcataagtacccaactccactgcattccccaaatacatcactaatacgcggtctgaaatatgtttcactatcgacagatcgtgagcaataaatatcagggaaagccccatttcccgctgtaattcctgcaatagattcacaacctgtgcctgaatggaaacatccaacgcagaaaccggctcatcacagataaccagtttaggctctagaatcagcgcacgggcaatcccaatacgctggcattgcccccctgaaaactcatgggggtagcggttaattaggttaggtaacaaccctacccgcatcatcatatttttgactttttcttttatttccccagatttcattttggggtgataggttctgagcggttcagcaataatgtcaccaatcgtcatccgcggattaagggatgccagaggatcttggaaaatcatctgaatatcgttacgaatattccgccactgattgccactcatatccagcaggttttgtccaagccacgttactgtaccgccagaggctttaaccagaccgataaccgctctcgcaagcgtcgatttaccgcagcctgattcacccactacgcccagcgtttctccttcgtacaatctcagtgtaacgccatcgactgccttcagagtttttgctggttgccagaaccattgtttcccgtctttaatgtcaaaataaacttttaggtcatcgacttccaacaggactcgtttttcagctgctgcgttcataccaattcctcctgaggtttaaagcaggcacgcaagcgcccaagatcaaaatgttccaactgtggctcttcgttggcacaacgctcagtggcaaattgacaacgcggctggaatgggcatccttttggcagtctcagtaagttaggtgggttgccctgaatagtcgtcaatgattcctcatcgtcatccagtcgaggaaccgcatcaagcaacccaatcgaatacggatgggtcgggtgataaaatatatcacgcgcagaaccatattccatggttctgcccgcatacataaccagtactttgtcacaaatacctgcaacgacacccaggtcatgggtaatcaggatgatggcagtattaaactctcttttcagctcgttgagtagtgtcatgatctgtgcctgaacagtgacatccagtgctgttgtcggttcatccgcaatcaacagtttgggctggcataataatgccattgcaatcatgacacgttgacgcataccaccggagaattcatgcgggtacattttcatccgcttacgcgcttctggcattttgacagcatccaacatacgaatggattcttcgacagcttcacttttactgatgcgcttatgcaacatcaagacttcagttagctgttcacccactcgcatataaggattaagggaagtcattggatcttgaaatatcattgagatctcttccgcccgcattcggtttagatctttttctttcaggttgagtatttctcttccattaaaagcagcagaaccactcacaacaccattactggctaataatcccatcagggcaaaagcagtctgtgatttaccggagccggattctcccactatgcccaacgtttctcctgcttttaaatcaaagttcagtttatttacggctatcacactgccatcgggtgtgctgaacgcgacattcagatctttcaccgttaatagtggctcagcacttttagcattttttgaagcttctacgctattcataggctctccttaacggtctttcgggtcgagggcatctcgcaggccgtcaccaataaagttaaaacaaaacagggtcagtaccagaaaaccagccggaaacaacaacaaccacggggcgacttccattgaattggcaccatcgcttaataaggctccccagctactgagcggctcctgcgttcccaatccaaggaagctcaggaaggattcaaacaggatcatgcttggcaccagcaatgaggcataaaccaccacaactcccaatacattcggtacgatatgacgcaaaacgatatgacgggtggatacaccgcccactaatgcggcttcaataaattccttacgcttgaggcttaatgtttgaccacggacgatacgcgccatgtccaaccatgacaccatgcctattgccacgaaaatcaacaggatgttttgcccgaagaaagtcaccagcaggatcacgaagaacatgaatgggaaggagtttaatatttccagcaggcgcatcatgatcatatcgactttaccgccaagatagcctgatgtcgccccatacagcgtgccgaatatcacagcaatcaaagcggctgcaataccgaccatcaatgaaatacgcccaccgatagcgacacgaaccagcagatcacgccctgatgagtcggtgccaaaatagtggctagattcggaatcaggtggcatcgtcatcatattccaatccgtatcgtcgtaggcaaattgagacaacactggcgcaaaaatcacaaataatgtgatgagaagcagcacacacaaactcgtaatcgctgccttgttgtggataaaacggcgtcgtgcgtcctgccacaaactgcggccttcaacttccagttgctcagaaaaattttccagagcttcgctatttcgtttatttagtaacattgcgtgctccagtctcagtaacgaattttcggatcaatgacggcatacagcacgtcaacaatggcattgaacagaatagtcaatccccctaccagaatcgtcaggctcaataccagtgagtaatcacggtttaaggcgccattaacgaacaactgacccagtcccggtaagccaaagatggtttcgatgaccattgaacccgtaatgatgcccacaaatgcaggccccatataagaaatgaccggcaataaggcaggtttcaaagcatgacggaagataatcgctcgcaatggcagccccttggctcgtgccgtacgaataaagtttgaatgtagtatttctatcatggaaccccgggtaatacgggagatgctggcaatataggcaagagacaaagccaccatcggcaggatcatgtacttcggcgcaccaccattccagccaccccccggtagccacttcaatataatggcaaaaatcagtactaataagggggcaaccacgaagctggggatcaccacccctgtcatggcaaaccccatcaccgtgtaatcccatttagtattctgattcagtgctgcgatagtgcctgcactgacgcccaatacaacagccataataaaagcagcaaatcccagtttggcagaaaccggcaatgcttctgccaccaaatcgttaacactgtaatctttgtatttgaatgatgggccaaaatccccttttgaaagctggactaagtaattgaagtattgtttatagataggatcattcagatgatatttcgcttcgatatttgccatcacttctggcggtaattttcgttcacccgtaaatggactgcctggtgccaaccgcatcatgaaaaatgaaatagtaattagaattaaaagtgtcgggatcgcctctaaacagcggcgtaaaataaatttaaacattgcccgttcctattgtttgaccaaaccatggcctttaataattttacagtcgggtagcctgaatcaggccacccgactgttcctagtgttttataatgtaaaaatccttggtatggatgttatccaatgggtctttaccggtataaccccccacataaggtttcactaaacgggtacttacatagtaataaagcggaacaacggcagaatctttatctatcagagcattcgcttgtttgtagatttctactcgctctgcatcggtcttcacttttaatgcttctttcatcaaagcatcaaatgcttcactcttgtagtgagctgtattgttgctgctataagataatttaacattcaggaaagtcgtgggttcgttataatcagcgcaccagcctgcacgagcgatgtcataattgccttggtggcgggtatcaaggaaagttttccattcctgattctctaaagaaacctcagcaccgatatttttcttccagatggcagcggccgcaatcgccatttttttatgcaaatcagaagtgttatacaacaaactgattttcagagggttgtctttactaaatcccgcctctgccaagagttttttggcttcttcattacgttgctgctggtttaatttggtgtaccaatctggtttttcatctttaaaatcggcaatgtaaggcgggacccaaccgtaagcgggcgtatcaccttgatttttaactttgttagtaatcagatcgcgatccatacccaatttcaatgcagtacggacgcgaggatcattgaagggtggcttctggttgttaatttcataaaagtaagtgcacaaataaggattaacacgtaactgatcgggaatttctttttttagtttttggaatagttcgatcggtagattgctataagtcatgtcaatttcaccgctgcgatagcggttgacatcagtcacttcagacgaaataggcaggaaggtaacttggttaatgatagtatttttgttatcccaatatgtcgggctacgctcgaaaacaaggcgttcattgatgctccagcttttcagtttataagcgccattacctacgaaattttgcggctgagtccatctatccccatatttttcaactgttgcacggtgcactggtgacattgtcgaatgaatcagtagtctgaccagatagggaacgggttcgctgagtgtcacctgaagggtatggtcatccagcgccttaacacccagtgactccggcttttgttttcccttgatgacatcatcaacattaataatatgagcatattggagataacttgcgtaaggcgatgctgtatttggatcagccagacggcgccagctgtaaacaaaatcctgcgcagtaaccggatcaccattcgaccacttggcatctttacgcagatgaaatgtccaaaccttgaattcctgattttcccaatgagtcgctacgccgggtaaaatttcgccattagaaccattaatcacaatcccttcaaataaatcacgagctatattggattctggcaccccttcaattttatgaggatctaaagattgcggttcagagctattattacgcaccaaaacttgtttttcagccaactgcactcccgcaggaacctgtgcagcaaatgcctgccaacccgtcatcatacctaacgctaccgtaatgccagcagctaaccttttctttgttgtgtttaccatattattattactccaattgatatcatccgatttttaaaagccatagtcactttttggaatggttgttttccgtatccaaaaggaactattttgtttgcaataaggcaatccgttgcaataacgatcagtcattcgcttttttaatatagagattcttaaaatcgatataatcaaggggatctttccctgtcagccccaccaccgtcgggcgaatcagacgcacactgacacggtaataaaccggtatcagccctgagtctttatcaagctgagcttcggcctgctgataaaatgctttacgtgctgcttcatctttcgcggccagagcctgactaagatagttatcaaaggcagcgctttgatagaaacctgtattgttactgctatcggacaacagagtattcaggaaggaagaaggttcgttataatcaccgcaccatgttgcccttgccacatcataatttccttgatggcggctctccagtgaggttttccattcttgattctgcaacgtcacttgtgcaccaatgttcttctgccacattgatgctgcggcaatggcttgttgtttgttttgatctgacgtgttgtacaataaagtgaatttgagaggattacgggcatcaaaaccggcttctttcaatagatcctttgcccgttggttacgttgttcctgcgtccagtttgcccattctgggttgatagtaaagccgccatcaccaatgtaagtaggggtgaaaccataagccggaatctgcccctgccccataatcctttcagcgataatatttctgtcaaggctcaatttaatcgattcacgcacccgtttatctttaaacagtggatttttgttattaatttcatagtaaaacgtgcacaagaaaggtgaaacgtgtagttggtctggaatatcccgcttcattttctggtacaaataaggcgtaatagcaccattggtaatgtctatttcaccactgcggtaacggttaatatcactgacttctgagacgacgggcaggaaggtgcctttttcaatgatggtttctttattattccaatattgcgggttacgtgttaagacgatacgttcgttgacaacccaatctttcagtacataagccccattgccaatataattttctggtaacgtccattttttatcgaatgcctcaaccacatcttgcctgacgggtttcattgctgtgtggctcaacatgtctaccagatagggaaccgaatggctgagagttacttgaaaacggtgatcatccagcgctttgacgcccaattgctcaggcgcttttttcccttttaagatatcctcagcattctgaacataagtatattgcagataactggtataaggtgaccccactttaggatcagcaaggcgacgccagctatagacaaaatcatgggctgtgactggcttgccatcactccatttggcattgtcacgtaaataaaacgtccagaccttataatcttgattttcccacttttctgccacccctggcacagtctcaccatcaggccctgtcgtaaccaatccttccagtaggttgcgaataatcgtagtttcaggtgcaccctcaaccttatgaggatcaagtgaagcgacttcaacgccattattaacagtcacttcctgcttttcagccaatgccactcctgcaggaacagttgcagccatcccctgtgctacaggaaacgataataaagcaatagtcgatattaactgacccaactttgatggtgttttcctcatttttcgctccaagttatcaacagcaaattaattgttttttaattgagcaaccctatcatcttactcattttgttaataaatagtaattcgtctattaaaaatctatattcgcataataattgttataatatttttataaatggtttattaaatagttaaagtaactcgccatttttgtgcaaagtacattcacgagacaaatacaaccacttgataatcattgattttatttttacttttatcatcttggattcagacaattccaccaaaaagaaaataaacattattttaacaaaatgcaatcatcacagagtaaaagcccacatccatcacaaaacagtgaatcaataaagctgttaatggaataatggaaagaaaatagtgtggaaaattacaggataactttgcagtagtagcagataagaaaggaataaaatataaataattgtttttaaaaaatgatacaggaacgacgttattgattaatcatatttctcattggttgtttattagctcatttttagttaattcattccctatttcagtaaaaatttctcttttttatattaactttctaaatcaatacaaacgttaccattacctgtgcatatcacagtaatccaggaaacacggcttttgttcctgcacaataaactcaattcccagcgacattaacaatagtcccataattcgggtaataacattaatacctgtttgccccaaaaatttgaccaataaagtcgctgaacgaaataataaccagcaacaaaaagtgaatagcaggcaggttaatgcaagccccaaataattttgccatccttgataacatgcactccatacaatacaagagctgatagctcccggccctgccataagaggcaatgccaatggaacaaccgcaatactgaccctaaccgctgtttctgatttttcctgcttattttgtttatcctctcccagtttgccgttaatcattgacatcgcaattgtcactatcaacaccccacctgcgatacgaaatgaatcgataaaaatgccaaacatgtgcaggatagagtcacctatcagtaatgagatacacaaaataatggcaacagacaaatttgcgataaggtttgttttattgcgccccgctggtgtctgataattcgtcatactaatgaagacaggtaaaattccgatggggttcaccaaggcaaacaaccccataaaaaatttaatatacccagaaaaccccagcaatgattcgctcacacataacctctctgtatataaataaacaaaacttttaacaacacttaagaaaataccgtaaaaaaaatattttttcgttacgttaaatcaataaacccagcgttctgattcaatcaaagcaacgttctccataagacatactataaagatttagttaatcaattgtgccattaaagttaaatagatatttaaattcacacttatacatcaattgataattattctcataaaggtataaagctgaatggaatcagctaatgttttagtgatctaaatcactaaaacaaagccagcaagtgataagctgtgctcaacattaaatatcaggcaaggtgcataattaatatatcaactcattaatttagataattttttaaggtaattagcggtgttcatgattgaatttcgaacgatgaatctcgctatattgtttaataaatgaataatctcacagctaatttccttaaaaaatttaacgtttatcaggagtaattttatggctgtaactcagattgccgaactcaatgaattagttgctcgtgtaaaaaaagcccagagagaatttgcccatttttcccaagaacaaattgaccgaattttccgtgcagctgctctcgcggcagcagatgcccgtattccattggcaaaattagccgtagctgaatctggtatgggtattgtggaagataaagtgatcaaaaatcacttcgcttctgaatatatttataacgcctataaagatgataaaacctgtgggattttatctgaagataatactttcggtacgataaccatcgctgaacctattggcttgatttgcggtattgttccaaccacaaatccaacatcaaccgcgattttcaaggcactcatcagcctgaagacccgtaatggtattattttttcaccccatccacgcgcaaaaaaagcaaccaatagggcggcagaaatcgttcttcaagcggctgttgcagccggtgcgccaaaagatatcatcggttggatagatgaaccttctgttgagctatccaatgctttaatgcatcaccctgatattaatcttattttggcaacgggtgggcccggcatggtaaaagcagcctatagctcaggcaagcccgcaattggtgttggtgcgggtaatacgccagtcgtgatcgatgaatctgcggatatcaaacgtgccgtagcatcgatcctgatgtccaaaactttcgataacggcgtcatttgtgcttctgagcaatctgtaattgtcgtcgatagcgtttatgatcaagtccgtaaacgtttctcgacccacggtggttatctcctgcaaggagaggagcttaaagccgttcaagatatcattttgaaaaatggcagtctgaatgccgccattgtcggccaacctgcaaccaagattgctgaaatggcaggtatctgcgttccggaagaaactaaaattcttatcggggaagtcactctggtggacgaaacagaaccttttgcccatgaaaaactttcgccactgcttgctatgtaccgtggtaaaaactttgaagatgccgttgaaaaagcagaaaaactggttgaaatgggtggcattggtcacacctcctctctctatactgatcaggataatcaatccgaacgtatcaaatatttcggcgacaagatgaagactgcccgcattctgataaatacaccggcatctcagggtggaatcggcgatctttacaatttcaaactctccccttctctaacactgggttgtggctcttggggaggaaactccatttccgaaaacgtggggccaaaacacctgatcaatacgaaaactgtcgccaaaagagccgagaatatgttgtggcataaacttcccaaatcaatctattttcgccgtggctccctgcccgtagcactggaagaagttgctacagatggcgcaaaacgtgccttcatcgtgacggaccgtttcttgtttaataacggctacgccgatcaggttatcaatgtatttaaatctcacggaatagaaaccgaagttttcttcgaggttgaagccgatcctactttaagcatcgtccgcaagggcgctgaacaaatgcatctgtttaaacctgatgtcatcattgcccttggtgggggctcacctatggatgcagccaaaattatgtgggttatgtatgagcatccagaaactcactttgaagaattggcactgcgttttatggatatccgcaaacgcatctataaattccccaaaatgggcgtgaaagcaaaaatggtagctattacaaccacctctggaacaggttcagaagtaacaccttttgcggttgttaccgatgatatcactggacagaaatatccattggcagactatgcattaacacctgatatggcgattgtcgatgcaaaccttgtcatgaatatgccaaagtcactgtgtgcctttggtggattggatgccgttacccatgcactcgaagcttatgtttctgtcttggctaatgaatattctgatggtcaagcattgcaagcgctgaagctactgaaggattttctgcctgccagttaccatgaaggcgctaaaaatccagttgcccgcgaacgcgtccataatgcggcaaccattgccggaattgcctttgccaatgcttttctgggggtctgccattccatggctcataaactgggttctgagttccatatcccacatggattggcgaatgcgttgttgatctgtaacgttattcgctacaacgctaacgacaacccaacaaaacaaactgcattcagccaatatgaccgtccacaggcacgacgccgctatgctgaaattgcagagcatctgggattgacggcatcagaggatcgcactgccgccaagattgaaaaattactggcttggctggaagagctaaaatctcagttaggtattccagtgtcaattcatgaaacaggtattcaggaagccgatttcctggcgaaaatcgataaacttgcggaagacgcttttgatgatcaatgcacaggcgccaatccgcgttatccattaatttctgagttgaagcaattgatgctggactctttctatggtcgtaaattcacagaatatgccatatctcagcaggcagaaaaatcaaacagaaaaaataataagaaacagtaataaataatgatgtgatgtaatttaaaaggtgcagagaccatcccctgcacctttttattatttcattttctggcttcatgataatgcaaacataaagacgccaggttcatggaactttttttgtctgagcttcacgaataacgtccgtatagtgcctacgacacacggagacgtatttttcattgcctccaatatcaacctgtgcaccatcataaacaacgtttccgtcgctgccaaaacgcagtacacgactggcttttcttccacaatggcagatggttttcaattcaaccaatttatctgaccaagcgagaagatattggcttccactgaataattcaccttggaaatctgttcgtaatccgtaacaaaggacagggatatcgtcataatcaacgatttcacacagttgttcgacgtgttttttcgttaaaaactgacattcatcaatcaagacacaatggactttttccacctcgttttcacgtctgataagttcagcgatatttgtctccgatgaaaataataaggcatcagcagatagaccaatacgggagctgacccgtcctttaccaaatcgtgtatcgatttctgctgtaaaaatcagcgttctcattcctctttcgttatagttataggaagattgcaataaagaagttgattttcctgcattcatggcagaatgataaaaataaagttgagccattggcccgtccatcctcttgtcaaatttaatcaggtgataaatctttgcaagtttaccacaaattccgcctgaaattatcccctgttattgacgaattcaacgtagcagaaagaaattagaacaaataagaaaagattattttcatgataatcatcacatttgtgtatataaaatcaactccataagcacattcggcatgataaacgaacgaaattaacatcaaaaagaaatagttatttttctttccattctttgcatattaataatcaaagtggtttacttttgttcaattcaatcactataatcataactaatggattacccataaaaaaactttcatctcatccttgttttttaccttattttgagaagaacagttaacattccttacggattgactataaactagttttatacgtagaagtttatctcccactcagctttgtagtaatctacctcaaacggttattgagaaatgataaacccaatagcaggattaaaacgcaatatatcgattgctaaaagaattgcgttttaaaatgatatgttttagcctgagaaagtaaattcactattgcagaaaataaaatagcattctattattatccgtacatcagccatcatcattataatttgagaccaggacaatgagcgaaaatttaaaatccttaaataacatccgtaccttgcgcgcacaagcaagagaatgtgaacttactaccttagaagaaatgttggaaaaactaacgattgttgttgaagaacgtcgtgacgaagacagccaagctcgcgcacaaatagaagagcgcagccgtaagcttcaagaataccgtgaaatgctggagaaagacggcattgaattaagcgatttagtagatgctttaagcggtaaagccactagcaaatctaagcgtgctacacgtccagccaaatattcataccttgacgaaggtgaaactaaaacttggactggccaaggccgtacaccagctgtaatcaaaaaagcaattgatgaagaaggcaaaaagctggacgatttcttgatctaatcagttgttttgtaaacttaataacaaaaataccctatcaagggtatttttgttttatgattaatatatctaactaagttatttattggctgatgtaagggcacagagggttatattaacggctaaatcgcctgcatattcacgatgtgctaaaaacaaatttaacactaacttagttttttattaacatagaattataaaaaaggagcgaaccgctcctttttactgccttttcattgttccgatttctggtaaaaatccaaataccaatcgacaaaccgtttcaccccttccttcactggggtatcaggtgaaaagccaatcttatcataaagtgtgctggagtccgcacaagttgataacacatcgccatcctgaatttccataaagttcttcttggcgttaatccctaatgacgcttcaatagcttcaataaaatcacccaattttgtcggctgaccgttaccaatattgtaaatacgatacggagcagaactggaagatatcgccccatcttcaactgaccagtctttattaggagtaggaatgatatcttgcaatctgattatagattcgacaatatcatcaatatatgtgaaatccctcaccatattaccatgattataaacatcaattgaccggccctctaacatggctttagtgaacttaaataaagccatatcagggcgtccccacggcccgtatacggtaaaaaaccgcaatcccgttgttggtagttgatagagatgcgaatagctgtgagacattaactcatcagtttttttcgtcgccgcatataaagaaacaggatgatcaaccgaatcattggtggaaaacggttgctttttatttaatccatacactgaacttgaagatgcatataataagtgttcaacacgattatgacgacatccttcaagaatattgatatgaccaacgatattggcgtcaatatatgccattgggttttgtattgaataacgaacacccggctgagcgcccaaatggatgactcgctgaaattggtgtttagcaaacaattccgggattgcaattctgtcggccagatccaatttttcaaattgaaaactcggatgagggagtaataaatttaatctcgcctgcttcaaattaacatcataataatcattgatgttatcgataccgacaacttcatgccccatacccaataatcgctggctaacatgaaaaccaataaaaccagcagaacctgtcactaaaaatttcatatcataactcaaacaactggattgatagaggcgccacgaccaatgccatagtaagtgaatccacgcgattgcaggcgttctggatcataaagattgcgcccatcaaaaattattggcgacttcattgagtccttcattatatcgaaatcaggcgctctgaagttctgccattccgtacaaataatcaaagcatccgcaccttttaatgccgcttcttttgttcccatcagagaaagatcatcacgctggccataaatacgctgagcttcctgcatagcttctggatcatatgcctgcactttagcgccgctttcccacaatgcttccattaatacgcgacttgatgcctcacgcatatcatccgtattaggtttaaatgataatccccaaattgcgaatgttttacctgataaatcatcaccaaaatggcgtttaacaaaagtaggcagcttactcttttgtttttcgttaaccagttccaccgcctgaagtattttaggtgtatatccaatttgctcggaagtccggattaatgcctgaacatctttcgggaaacatgaaccaccatatccgcatcctggataaatgaaatgatagccaatacgcggatcagaacctattccctgacgtacatgctcaatatcagcccctaacatttctgccaagtttgcaatttcattcataaaactgatcttagttgccaacatgcagttagctgcatatttagtcaactctgcactgcggatgtccatgacaatcatacgatcatgattacgattaaatggctcatacagttcgcgcatcacatcaatcacattgtcattatcacagccaattataatacgctcaggccgcatacagtcagaaatcgctgccccttccttcaaaaattcagggttggaaacaacatcaaatggaaaatctgcgctgcgttgagttaataccgtttgcataactgctctgactttatcagccgtacctacaggtaccgttgatttatcaacaacgactttgtagccatccatgttttccgcaatagtacgggctacggcagtgacatattgaagatctgctgatccatcttcatcaggaggcgttcctactgcaataaactgtaatttgccatgtgcaacaccggctttagcatccgttgtaaaattcaggcgcccttccgtataatttttcttcacaagcggcactaaacctggctcaaaaatagggatctggccatttttcaggttttcgactttttttgcatcaacatcgacacaaagcacatcatgcccgacttcggcaaatacagttgcttgaaccaagcccacgtagccaataccaaatacagtaactttcatatcacaccttaaattaccaatagattatttttcgatctgattctgcaatgtcatgatccaatccttgaatgctgcacctaagtccttatgcttcataccatattcgacgaatgcctgcatataacccaatttattaccacaatcatgactgcggccttgcaagtgataagcttcaacgggttctttttccattagcatagcaatggcatctgtcagctgaatttcatctcctgcaccaggtgcagttttcgccaataatggccagattttttcagacaacacatagcgaccaacgatggaaagattcgatggggcttcttccggtttgggtttttcaacaacacgaacaataggtttgctgtcaccaggttgcaggttttcaccaaggcaatcaacaaccccataatcggcgacgctttccaaaggaacgggttcaaccaaaatctggctcgctccactgctattaaagcgtgacaacatttcactcaaattatatttcgacaaatctgtactgtattcatccaaaatgacatctggcagaatgacagcaaatggttcatcaccaatcagtggcttagcacataacaccgcatggcccaatccttttgcgatcccctgacgggtttgcataattgtcacatgatttgggcaaattgactgtacttcatctagcaactggcgcttgaccctcctttcaaggatcgcttccagctcaaaactggtatcaaaatggttttctatagagtttttggatgaatgtgtaaccagaataatttcattaatacccgccttaatacattcattaacgacatactgaataagtggtttatcaaccagcgggagcatttctttaggaatggctttggtagccggtaacatccttgttcccaaaccagcaacaggaataacagctttttttacctttttgtttataactgacattacattgtctcctacggatttgttgtcgctgaaaaaacgcctttcgcagcttaaacaataacactaactttctgaaaaaacgtatgtgtgaagaaaatcgcccgcgtaaacaggcgtaaaaaataatgcgcccgagtataccagctaaatcaactagatttacagtgcgctggcgtttaattacattcccataattcaatgtgtaatatcgcctgagaatgatgcataaatgctatagaatcactgataaaatggtggggaaaacatcaattttatttgatttttgttattccatatgcggcattgccaaagagaactatgttcacatacctgatgtgaatgaatgatcttcaacgtaccaagaggaatccctctacccagctgctgttgatgattaccagactgaatacgcgcacttaatcctgctgatgacattaagatggttttattatgcgtattgtaataacccaataataatggaagtggttccgaaatctccgtatcatttaatatccggttcacccagttcatgatctcttgcatatctggtagaccactttttttatgaaactttcgctttttcaataagttattgaaaaccactctcaatagcagtgcagatacagcaccattatctttcgaacggctaatatccagacaatagaaaatcatttcattatcagaaagtgctgtgatgtcaaaaaccaaacccattttacctactgtatttaataagcggtaatttaccctacagttagcaataatttgggagacaggtggctgtagttgttgtaataaacaccagactgattccgtattttgttttagtttcgacagttcctgaatcaagcggttttgctctatcgcatcagacataaataccttcggatgtaaataatccaaagccattttctttacctcattgagattggctatcggctttaacagaatgtctttagctccaaggcgcaacacatcatctatctccgtcatcttatttgttgcggaaacaataatgataggaatagtcaaccccttaatcgccatatggcccataaattcaatgccacccataataggcatgcttaaattgcagaaaatgagttcaggttttatctctctatcaaccgtctgtaatgccatttctccatttgatgcacacatcgttatcgcacccagagagtttagataatctgttaataaggagcaaaaaacgggttcatcctctacaactaatatcctcttaccctgcaataccttttccacaacagtagccccttaccaagcattgcggctattacccatattcgggtatcatcagccaatgatagtccaataggtcattactatttgtactcttacatatctttgcagtatcggtcatattaacagcaactacttaaacaaccggagttattttgacaaaaatatgcccttgtggcagcgactcacttttcgtacattgctgcggcccctatcttgaaaatcaccactccgctccagatgccgaatctttgatgcgttccagatatagtgcttatgcaacaaaaaatgcagattatctcatcgcgacctggcacccagaatgtcaagcagaaagctggcgttctgaaatagaacagagttttgcgggtgtacagtggctagggctaaatgttattgagacagttgaagggcaacataataacgaatcctatgtcgaattttcagcctgctttattgagcaaggaaagcaagacagacaattgattcatgagcgctcccgttttttgcgcattgaccaacattggttttatttagatggcatacgtccccaaacaggccgtaatagtccttgtccatgtggttcaggcaaaaaatacaaaaagtgctgtggctagctcaagctcaatatccaaatatcaaacacaacaactcacatacagtgaagaacatttaaggatcatgtaatccatgcaaaacgcaaacatacaaaaaaaaatcttgcgtacaatctgtcctgatgccaaagggttaatcgcaaagatcacgaacatttgctacaagcatcaattgaatattgttcaaaataatgaatttgtagatcaccgtactggccgtttttttatgcgcacagagctggaaggtattttcaatgatgaaacatttctagccgatctggatgatgccttgcctgcgggttcaaaccgtgaattaaatacagcgggtcgtcgccgtattgttattatggtgacaaaagaagctcattgtattggtgacatcttggtgaaaagcgcttacggtggattggatgtcgaaattgctgccgttatcggcaaccatacgatcctgcaacacttggtggaacaatttgatattccgttccactacattagtcatgatggtttaacccgagaacaacatgacgaagcattgatggttcaaatcgatcaatataaacccgattatgttgtactcgctaagtatatgcgtgtcttgacgccagcatttgttcagcattatccgaaccaaatcatcaacattcaccattcattcttgcctgcttttattggtgctcgtccctatcatcaggcttatgagcgtggcgtcaaaataataggtgctactgcacattatgtgaatgataacttggatgaaggcccaatcatcacacaggatgtgataaatgtggatcatacctatactgccgaggagatgaagcgcgcaggattggatgttgaaaaaaatgtgctgagtcaggcattgcactgggtcttttctcagcgggtttttgtgtatggtaatcgtactgtcattctttgataaaagataaagtattttttgtctgtcaggtgcttattgctgttgatgatctgacctgatggaacgggatttgagcatcaagtttaaaaaaacagcatttgatactttattttcaattatctactttacagcggcggcttatctgatattatgccgaccgctgtcaacgataaattcaaaaatttggtggggttcccgagcggccaaagggagcagactgtaaatctgccgtcacagacttcgaaggttcgaatccttcccccaccaccatcaaagaaatactcttaatctccaataaatccaaaagtcaataaattcccactttgagtaagacaaaaaccttcgatcaaggttcgaattgagcacagcgaaataacaatatgtgaagtaagataacaatgtgcgaaacgcgttgatccgtaggaaggggaaagaagtgacgaattatccttcccccacaccatcaaatagatgttctgttactttcatcaactgccacaatcaacaggtgtccgcatggggaaagaacaaataattcgctcaaagagcagatgaatattacaaaattagcgtgtttgaataagcaccaagagcggagcttgggtatggcatttcgctccgcttatgcaatctgattactccatatcgctgacagagtctataaagcgatttaacacgcttgaatgagattttgatttgtagacataacactgattaactgcatcagttcgtgatattggaatgaagcctaagctttctccctcttccaatgcaccagagtgggaatctgtaataaagatataatctgttgactgaataaaattaagacagcactcgatactatccatttgccgtatattgactttttctccatttcttatcatctcttcttctaaattctttatcaaattacctttatagagcactggatcacataaccatgttctctttttcagcaattgagtaaagtcgccatgaacctcatccaataattctttacggcagcagatccctaaatttggcccttcaatttttcggacaaggctgaatcgatcactgagtactttttctgaacttaaaattatcgtattgccctcataatcaactatttcatcgatgttatcataactgaagcgtaatatattaacctgagcattatttctgtctgctgctttataaagcgaaattagatgctttttcttaccccaatcatggtatatatttacaacattacaaatactcccgctgatgtgtttctttgtaatttctttctctttcaaatagagttcttttaggtcattatatagctccactccgtctttggtcagaatcatcccaaacttctcccttttaaataagcgctttcctaacgtcgcttcgaagtctttaattgatttagcgactgggggagtcgtacggttcatcactcttgccgctttgcttaaagaacccatttccaccaccgccatgaatgcttctaatttacgagaaaaaaacataattcaccgttcctatgtaacttgtggctaaaataatttccttgaaatggccttctcatcaggtaaccgctaaatcaaacttgatattatgaaggtataattttgtacaataaaaacaaatgtttttcaaatggcatttatataaaaataccagtccctgatgcaataatgcggtttagatgaactatattattcatctatatcatgatgaatattccaccgtgattgtaagccattaataaatataagcatgacctacacgtttaattttctatcagagattgattaactcttctactttttcattaattattttttgtaatgcatgacacaaaataaatttataaaataaaaatacttgcaaaaattataatatcaaatgtttaatataactcatcataactaacggaccgttatttatccattaatttactatttattaattctatggttttcattatttaaaaacgattactcactcaaaatttcaggtaatgagagtattatattcagtatagtatgacatataggagtaaaatagctaaatatccaagtaatcagctaaaaattattatttaataaatggttacattcttatttatatctgttaacattgaaaaacagcttattctaaaggtgattataacgatatgaaatttgtctcattcaatattaatggcctgcgggcgcgtcctcaccaacttgctgccatcgttgaacagcaccaaccagatgttatcggattgcaggaaacaaaagttcatgatgaaatgtttcctttagaagaagttagcaagcttggttaccacatcttctatcacggccaaaaatcccactacggtgttgccctgctcacccgtcagcaacccgttgctgttcgtaaaggctttcctactgatgatgatgaagcacagaggcgcatcattatggctgatatcgaaacgccgcaaggcttattgaccataatcaacgggtattttcctcaaggcgaaagccgtgaacatccggttaaatttccggcaaaagagagattttatcaggatctgaatcgctatctggaaaaaaaccaatctccagattcacatattctcattatgggtgatatgaatatcagcccaactgatctcgatattgggatcggagaaaataatcagaaacgctggttaaaaacagggaagtgttcttttttaccggaagaaagagaatggatgggccgtcttaaagactggggcttaatcgacacattccgggcacagcatccagaagccagcgaccagttctcttggtttgactatcgctcaaaagggtttgatgataatcgagggctgcgcattgatttactgcttgccagccgcccattggcagaacggtgcctctcttctggcatagattacgctatccgcagcatggaaaaatcttctgaccatgcaccgatctgggcagagtttagaatataattttcaaacatgaaacacagcaccttcaatgacggtgctgtgttatcatttcggttactcttattccgttttattcactttttctttgcccttttttacctgttttgtttttccttttttgccttttgcgggaacaggaggcaagtccctaaaagctttcaagtttcgatactgtttcgcctgcccgattaactgctgtaacgtttcctgaaggggcagcataaaatcctgataacgaaactgtttttcactgatttgcgttaatctggattcccaatgtgcagtcatatccggtaatacagccatatccggcaatacatgaataagtgctcgtccagcaggcgtagcatgaatattacgcccttttttgtacaagaattctcgcttgaacagcagttcaataataccggcccttgttgcctctgtacctaatccatccgtcgcacgtagcaccttcttcagtgatttatcctgtacaaatcgtgcaatacctgtcatagcggatagtaaagtcgcatcgctaaaagggcgcggcggttgagtctgcctttccaccacttcccctttttcacacaaaagctcatcccccttggcaacaacaggcaatggagtgccttcattctcctcatcccgctccttgttgccaagaagagttctccaacctgcttcggccaggaaacgcgctttagcaatgaatttgccacccgcaatatcaagttcaatcgtgcatttacggaataccgcatctggtaaaaactgcatcagatactgtctggcaatcaaaccataaatttgcctttcattctctgtcaaattgacttggctgcttcgagcagtaggaacaatcgcgtggtgcgcatcaactttcttatcatcccagcaacggttcttcttatcactctccagtgcatcctgcggaagtaaatcagaagaatgaatcgaaatggcattcaagacagcatgacgcccgacgaaatgttcttcaggcaaataacggcaatcagaacgcggataggtgatcagtttatgggtttcatagagtcgctggcagatatccagtacattctgagcacttaaaccaaaacgcttggccgcttcaatctgcaaggaagaaagagaaaatggcaacggtgccgtttctgattcccgcttatcctgataggcagtaacataagcaggctgtcccgtaatacgagccactacatgctctgccaatggctggtgtatgagccgcccttcttcatcttgaaaatcaatgcaggattcactaggctgccataaggtcgtaaatcgttcctcgtttggcgtaacaatgtgcgccttaacttcaaagaaatctttcggcacaaagtgctctatttcctcgtcacgacgaacaaccaaccccaaaaccggtgtctggacacgtccgacagataacactccctgatagccagcattctgtcccaataatgtataagcacgagtcatgttaatgccatagagccagtcggctctggctctggcgagtgcagaaacacacagagggatgaattcccggttactcctcagacgttcaatcgccttgattaccgcctgggggttcaggtcattaatcagacagcgctggacgttctgttttttatcatccctaaggctcagaaaatccagcacttcgtccaccagtaactgcccttcgcgatcagggtcacctgcgtggataacttcgtccgctttttccagaagggatttaatcgtgttaagttgtttagccacagcaacccgtggcttcaactgccatttttcaggaatgattggtaaatcagacaagacccaacgcgcataacggctatcgtaggcatctggctcggcctgctccaatagatggcctacgcaccaagtcacgaattggttgttaccgcattcgataaacccatccccccgacgatggggtttaggcaaaacatctgcaatagctcgcgcgaggctaggtttttctgcaataaaaagacgcatggaatttattcaataacttcaatcaatgccctgtctgagcgtggttcagtcagttcaccaatggcaatcaaatcaatgttgtggcttcgtgcaatggccttcgcctcttccacggcatctggcagtactgccagcaataaaccacccgaagtttgtggatcacacaagagatggcgctgacgtgctgtcagttccccaatcaagtgtccataactgtcaaagttgcgccctgttcctccgggtacgcagcctttttcaatatagtcatcaacatctggcaatcttgggacttgtgaaaagttgaccgttgcctgaacgccggaaccctcacagatttcccccagatgcccaagtaagccaaaacccgtgacatctgtcattgctgtaacgccatcgataccagcgaaatctgcacctgccttatttagctggcacatcgtttcttttgcaataccttgatgcccgggttgaagtagtcctttcttctcagcagtagtcaataccccaatacctaaaggtttagtcaggaacaaaatgcttcccgcttttgcctgactattgcgtttcacacgatcgatattaatgatacccgtcacggccaagccaaaaataggttcaggcgcatcaatcgagtgcccaccagcaagagaaatgccagcctctttacatacggcccggcctccttcaataactttttgcgcgatttctggggataatttagcaattggccagcccaaaattgcaatcgccatgatgggctttccccccatcgcatagatatcactgatggcattagtggccgcaatgcgaccaaaatcaaatggatcatcaacaatcggcatgaaaaaatccgtagtactgatgatgccggtaccattgccgatatcgtatacggcagcatcgtcacgtgtttcgtttccaaccaatagatttgggtcaaaaaattttgcctgctcactgtgcagaatagtttccaacacttttggcgaaattttacagccacatccagcaccatggctatactgagtcagacggatttcagttgacatagctggctccacttagaaataactaacaaagttagttaaatctggtaatgctactttttctggtgctttgagtaccggtgttcccaagtagaggaacccgacgattttatcattctctccacatcccagacctgctttgacaactggatcttctgtccatgatcctgaacgccatattccaccaaacccctgagccacagccgccatttgcatggcatgaaccgcacagccagccgctacgatttgttcccatgcaggtattttcgtattctcaacaactttggcaataacagtgataatcatgggtgcacgataaggtgcatttctcgctttttcctcaatttcttggcccaaagcattctcaatcgccgatttttccaacaatttactgaatttatcaataccctcgccctgcatgacgacaaaatgccaaggacgcaatgccccatgatctggcgctctcatccctgccgccagaatatactccagctcatttccttcgggggcgggcgtggttaaacgtgaagctgaacgacgattcaacaaaagttccaaagcattcataatttcctcctgaataagataatttgtcacggctcaacattctctgtttaatcgttactaaatgaaagtacagaaactactttttcagtcattcctgtgatttccggctgacatttacggattagctgattaggataaccctatttgctctcatacttggagacgacatgcgtactttatggaagtttatagcagcattatttaaatggagttggaaactgctaaatttcgctcgccaacttatttcaaatctgatttttatcctactagtgattgtagtagctactggcattctggtttatcagcaacaatccaaatctggcgatgattatcgtggagccttatatgtcgatctgtctggcattgttgtggatcaagtctccgcccgtagtccattagatcaatttgggcgggatcttatcggtgcatccagtagtagctcgcaggaaacgtctctgttcgacattgttgacagtattcgacgggcaaaacatgacgctaaaattactggtatggtattaaaactagataattttctcggcgccgatcagccttccatgcaatatattggcaaggccatcaacgagtttaaggcagcgggtaaaaccgttatcgccatcagtgataattatagccaaccacaatattatttagccagctatgccaataaagtatacctttctccacagggagccgtgtcccttcatggtttctcaactaatcatctgtattacaagtcattattggacagtctgaaagtttccacccatattttccgtgtcggcacatataaatcagcggtagagccaatgacacgggacaatatgtccgaagaagcacgtcaagcagatagcctctggcttaatgaactttggaacaattaccgcaatacgattgcagttaacagaaaaatccctgccgataaagtgctgccggaacctatccagtttattgaaaaactccgtcaaactggtggagatagtgcactgtatgctgcaaaaaataagttagttgacgaaattaaacctcggaatgtcattgaaacagaattaagcaacaaatttggttgggatgaaaaaaacaaacatttcaattatatcagcctctatgattatatcgcacagcagccaatcaaaaattctgatcaaagcaatagcaacattgccgtaattattgccgaaggtgcaatcatggatggcagacaatcagaaggcatagcgggcggtgataccatagcggaacaacttcgtgaagcacgcctgaatccaaatataaaagccattgtgttacgcgtgaacagccccgggggtagtatcagtgcatctgaacttatccgcagtgaactcgtcgctatccgtgaaggcacaacagtaaaagataaagaaggtcgtactgttaaagaaaatcaaaaaccgattgttgtgtccatgggaggacttgctgcctcagggggctattggatttcaaccccagctaactacatcatcgctgacaaaaatacgctgacaggctctatcggtgtttttggtgttctcaatacttatgaaaaaggcttaaattatcttggtgtgaatacagacggtatttcaacgcatccgttggcagatatttcagtaaccaaaggaataaaccctatgttttctgatgtcatgcaactgtctattgaaagtggctatcataaatttatcgaactggtcgcacaatctcgccagaagacaccgaatgaaattaaagaaatcgctcagggtcgggtctggagtggcagtgatgccaagaagaatggtctggtcgatcagttaggtgactttgatgatgcagtcaataaagctgctcaattagctggtatcaaaacagtatcattgaattggatgcaaccagaactctcattctctgaaaaactcatgctggagttttcctcatcagcacaaacactgctgccaaatgccctgcaatcaatgttgccggctccgattgcccaaattgcgcaagatatgaaacaacaagctgtattttataaccgcatgaatgatcctcagaatatctatacgttctgcctgaactgtgcggatatccgctaaaaataacgttagacaatatcatcgaatttaaagcctgatccttacatcaggctttttttattccatatactccctataatccggctgagtatttttattgaggcgttaacatgcagaagaaatctatttacgttgtttacactggtggcacaattgggatgcagcgctcccctaatggctacatccctgtctctggtcatttacaacgacaactcgcgcagatgccggagtttcatcgtccagaaatgccaacctttaccatccgtgaacaccagcctctgattgattcttctgatatgagtccaaacgactgggggattatcgccaacgatatctaccagaattaccacgattacgatggctttgtgatcctgcatggtacggacactatggcttttaccgcgtcagcactctctttcatgtttgaaaatcttaaaaaacctgtgatcgtgacagggtcacaaatacccctggaggctctgcgttctgatggtcagacaaatttgcttaatgcactgtatctagctgctaactatcccatcaacgaagtcggcttatttttcagcaataaactgtttcgcgggaatcgaacaattaaagcccatgccgatggctttgaggccttcacatcccccaactgtcggccactgatcgaagcagggatcaacatccgtacgttcaatacaagcccgatacccgccagtcatgatgagtttaccgtacaccagatcacatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16896 - DNA, 859 bp, Xenorhabdus bovienii
  unsure (1)..(859): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgagaaagatgcctactatagcaactgaccgcccttctgaaaaattgcacttgtatcatagtaattatggtggttagctaccatcataagaaacaaggtgagcctcatattgcacatttaagcgagactttgttaataagcgaaggccccttgtttcaccttccacgccagcaccaatattgaacggtaaccaagagcaacgactctgtatatacaagtgaaattggcgtgatggcatcaaataagaggagggttattatgtattatgtcggaatagatgtcagtaagaataaactggatatttgtttgttatatgatggagttaaaggtaaacgcaaaacaaaatcccttctgaataatgaacattcagcctgtatgttaatagcgtggctagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatataaaaagagncctgatttatgccaagatg

SEQ ID NO: 16897 - DNA, 297132 bp, Xenorhabdus bovienii
ccgaagctgtcctccgggtcgtgaggctgcgtatcttacgctttcctctccgagtgtcaagcctttatttccgggctgttctctcttgtcatctcgacgcgtttgtatgtttgtcgtgacaacggatgcgcattatagggagccgtctgatttaggcaagccttttttgtaattatttacccaaacgcttataatttgggcaaaaaggctatttttgcctattttttatcgcatctgggagatctgcaaggctattaataaccagatcagcagtctgttctactgcttctgttaccgcttttccagtacgaacgagtactttggttccaacattggctgcatttgctgccagcatgtcttctattttatctcccaccatataagaagctgacatatcgatgcttaattcttcctgtgcatccaacaacatgcctggctgcggtttgcgacaatgacagttcttcttatatgcgtcagcactcccctcggggtgatgcgggcaataatagatgccatcaagatcgacacctcggtctgccagcgaccaatccatccattctgttaactgcaaaaattgatcttctgtaaacatctcccgagcaataccggactgattagttatcaataccagtgcgtagcccatttttttcaattcgagcatggcttcaatcgcgccatcaataaattgaaaattgtctatttcatgaacatagccatgatcgatgttaaccgtgccgtcacgatccaaaaatacggcgggaataccttgagtcacttgattactccaagaacgtacgaagcagacagtatcgcatgatttgttactgaatgagaaaccagcatttaatttattcgcagttgacttagacgtctagacgccttaacatccacattaattcatgacttgttgcaaacgttctcaagtcattcatctttacatctaataagaaaaaaatgataagactgactcagataaataaggtatttcaacaaggagcgcgctcaataaaagcgctttcagatatcgacttgcatgtcccgctggggcaaatatatggtgttattggctcttctggcgctggaaaaagtaccttaattcgttgcgtaaatatgcttgaacgcccaacctcaggtcaggtattggttgatgggcaggatctgacatcgctttcagagcgcgaactgacgcgtgcccgtcgtcacatcggtatgattttccagcactttaatctgctatcttccagaactgtgtttgacaatgtggcattgcctttagaattggacaacacaccaaaagccgagataaacgctagagtcaatgaattactggaattggtcggtctctctgataagcatgatgcttatcctgctaatttatctggtggtcagaaacagcgtgtagctattgccagagcactggcaaattcaccgaaagtacttttgtgtgacgaagccaccagcgctctggatccagcaacaacgcgttctattctggaattattaaaagacattaaccgccggttagggttaacgatccttctgatcactcatgaaatggatgttgttaaacgcatctgtgatcaagttgcagtaattagtggtggacaattaatcgagcaggatgtagtgagcgcaatattttcacatcctaaaacacctgttgctcaacaatttattaaatctacgctgcatttggatatccctgaagattatctacaaaaattgcagcctgaatcagcgcctgatcgctgtccactagtgaaactggaattcacgggtaaatcagttgatgctcccctaatttccatggcagtacgccgctttaatatcgatatcagcattttaagttcccaaatggattacgctggtggcgtgaaatttggcgttatgctggctgaattagacggtgaaagcagcagtattgaatcaacaattacgttcttagaagaacaccatgtgaaaatagaggttctcggttatgtctgaaggaatgattttattactggctaaaggcgtctgggaaactctggtgatgacttttgtttctggcttctttggttttgttattggcttaccggcaggtgtgcttttatatgttacccgtccaggtcagattatagaaaatggggcactttatcgcatactatctgctctggtgaatattacccgctcaatcccgttcattattttgctggtatggatgatcccattcactcgactcattgtgggaacatccatcgggttgcaagcggcgattgttcctttaacggtcggcgcagcaccttttattgcacgtatggtggaaaatgccttattggaaattccgtcaggtttaattgaagcagctcgcgcaatgggagcgacaccgcttcagattgtcaaaaaaattctgttgccggaagcattaccgggtttgattaatgccgctacgattaccttaattactctggttggttattccgcaatgggaggcgctgttggtgcaggcggtctaggccagattgggtatcagtatggctatattggctacaatgcaactgtgatgaataccgtattagcgttgctggttattctcgttttcttgattcaattaagcggtgatcatttggccaaagcggctaaccgtaaataaccttatttcaattgtggtgtctgttacggcatcttttaagggcttatacctaaaagcctcatgagtagtacgcagtagcctggtaagacaggttctaaatcagtattcaataggggtgaaaatatgtcagtaaaattgaaatccatcgttgcaatcagtgcattattaggaacattaattcttgcaggctgcggtcaggaaccaagagatccaaaccacattaaggttggagtcattgttgggcctgaacttgaagttgcagaagttgccaaaaaagtggccaaagagaaatatggccttgatgttgagttgactacgttcaatgactatgttctgccgaatgagtcactgagcaagggagatattgatgcgaatgtcttccagcataaaccttatttagatcaacaaataaaagaacgcaactacaaattggctattgttggtaactctttcatctacccaatagcagcttattccaagaaaataaaatctctggatgaattgcaggatggtgctcaaatcgctctaccaaacgatccgaccaacttgggccgttcactgttgttattgcagaagcaaggtttgattaaactgaaagatggcgttggtctgttgccaactattttggatgttactgagaatccaaagcatctggacatcgttcaattagaagcaccacaattaccacgttcactggacgatcagaaaattgccttggctatcatcaataacacctatgctggccagattggtctaacaccggaaaaagatggtttatttgtggaagacaaagattcaccttacgttaatatcatcgttagccgtgaagacaataaagatgcggaaaatgttcaaaagtttgttaaagcttatcaatctgaggaagtagaacaagccgcccagacaattttcaaaggtggtgcgctaaaaggctggtaacctttcatcttcagtcaatcaagattaaaatcatcgggcgggtattattatccgcccattttgactgggggagccaaacgcttttgatcgcagtttcatgcatcgacattcacagccccccactcaccgaccttaccagaataaggattcaacgcgatgcgtatgctacctatctgtttcatggcgctatttatggttgggtgtacttctctgtcaactcaggtcgaaaaacctactcaggtaggctcaaagttgaaacatcagccagccaagaaaagtaaagtgtcgtcttacattgagctatacactaagacagaagaactgttaggcactccatttaaagatttaggtatcgttttcggggaatcctgtcgcactacgcaacaagatcctcctgccagcattgcagttgcacggaaaaacatgctggcaaaagccgcatctctgaaagctaatgcagtattacttcatcaatgcgcaatactgtctaatcacaactgctaccagactgcgatttgtgaaggctctgccctgcttaccactaaataatgatgactaaaaaaacgctcatggcagattttcattttactcaaataggaaccatccattctccttataaagagaagtttgctattccccgccaaccgggtttggtagaagatgggacggggcagctagagttgctggctccttataaccagattgatgcggtacgtgggcttgaacaattcagtcatttatggattatttttgtttttcaccaaacgatgaatggtggctggaatccattagttcgcccaccccgtttggggggaaatgccaaaatgggcgtgttcgctacccgctcgacattccgccccaatccgattggtatgtcgctggtagaattgaaaggtattcaatgccagaacaatcgggtcattttggaactcggcagtctggatttagtagatggcacacccgttatcgatatcaagccctatctgcctttcgccgaatctcgcccagaagccagagcgggttttgcacaggaggcaccagacaccggaatggaagtctcgttcttaccaatagctgaacatcaactatcgtcccatcaggcaaattaccctcatttacgacgtttcatcagtcagatattggcgcaggatcctcgtccggcctatcgtaagaaagaacaggaaaaccggatatatgcagttcatatcttggatttcaatgttcgctggcagatacgtgacgctatgacggaagtggtttctattgaacaccgttaaaaccccttttgacatagcaaactcgctggtagactagcggtttatctttattttctgggttgggtggcacaatcttgtcgcccagaagcaatttgctgtccaatggaaacttactatgcgtactagccaatatctgctctctactttaaaagagacgcctgctgatgcggaggttgtcagtcataaactgatgcttcgtgccggcatgacacgtaaactcgcctcaggtctgtacaactggatgcctacaggtgtccgtgtattaaaaaaagtcgaaaacattgttcgtgaagagatgaataatgctggggcgattgaagtttccatgccggtagttcaaccggcagatttgtggcaggaaagtggccgttgggaacaatatggcccagaattactgcgttttgaagatcggggcgcccgtcctttcgttctcgggccgactcatgaagaagtcatcaccgatctggttcgtaatgaagtgacttcatataaacaacttccactgaacctgttccagatccaaaccaaattccgtgacgaagtccgtccgcgtttcggtgttatgcgttcacgcgaattcattatgaaagatgcttattctttccataccaaccaagagtctctgcaagagacttacgataaaatgtatgctgcctacagcaaaatttttactcgtattgggctggatttccgtgctgttctggcagataccggttctatcggcgggagtgcttcccatgaatttcaggttctggctgacagcggtgaagatgatattgccttctccacagaatctaactatgcggctaatattgaattggctgaagccgttatgccatcccacgagcgagctgtcccatcagaagatatgcatttggtagagacacccaatgctaaaaccattgctgaactggtcgaacaattcaacttgccgattgagaaaaccgtcaaaactctgatcgtccatgcggcaaaagaaagcggtcatcaactggtcgcattgctggtacgtggtgatcatgaactgaatgaaatcaaggcgggaaaactaccattagtagcaagtccgctgaatttcgctaccgaagaagaaattcgtgccgttgtacaggcaggcccaggttccttaggaccagtaaacctgcctatgcctgttatcattgaccgtagcgtatctgtcatgagcgattttggcgcaggcgcaaatgttgatgataaacattatttcggcattaactgggaacgtgacttaccactgccagaaatcgccgatatccgtaatgtcgttgaaggtgatgccagcccagacggtcaaggtacactgctaatcaaacggggtattgaagtcggtcatatcttccagttaggcaccaaatactccgatgccctgaaagccacggtgcaaaatgaagatggtcacaatcaagttgtctcaatggggtgttacggcattggcgtaacccgtattgttgctgcagctattgaacagaaccacgatgatcgtggcattatctggccagatgccattgctccattccaagtcgctcttttacctatgaatatgcacaaatcttatcgggtgaaggaagttgctgaaaaattatatgcggacttacatgccaatggtattgatgtgattttcgatgatcgcaaagagcgcccaggtgtcatgtttgctgatatggaactgatcggtgtgccgcatactctggttattggcgatcgcaatctggataacggcgaagttgaatacaaataccgccgtaatggtgataagcaaatgctgaaactggaaggtattgttgaatatctgaaagggcaaattcagcagcattaatactgtttaagcgccgttgttcaagttcagaaaaaacctgcgtattcaatgcgcaggtttttttatgtatgacaactaagttttgttatttcctggtctgacaagaggctgacttgtcaaaatggattttgcctgtttgaatcagtgcatgatcaaacacaccatcttccatcgaaggccgaagcgagtagtaaccttcgacttccacataaacaggctctcccccttccacacctgtcgcactgtagccacgttccaaatcgatattttcagacgcatcatagagttttccggtacggcactctgtaaatgtcgcactgtcagcgatatagctgtattcccccgccatcttttttggtgtaacttttcccaattcataattgaaatttgactggattggttcaccgttgatatccagcatgaccagattttcacctttcatctgataataagatttcttactatcctcatgcgtcaaatctatctttttaccgttttttatccaatgacccgtttcgaaaaaggtgttttcttcatttttcgcttccagataaatttgtcccaatatatatgagccatcgcttgaaagctgcaaagtagtctcaataccggtgcagtccgcacaaggtacaacgccagtaaacacgctctcagttgtctgaagtgcattctcctgaagcgtagcattatcctgagaggccactttgttctgacacccaaccgcggttaacactcccacagcgaccaaggcgagcaatatttttttattcatcatcattttcatccaataaatccagcagataacctaatattcataacgtccatctcatgtaaaacatgaacttttcttaacaagattgacattactgtaccgtatctcaaaatgcatggggaaaaaaatcaaataatatgatgtaatttcgttgcgtaatgataagacttagatttaatctactttctttccaacgcaattcaacagacttaattcagtaatcacggaaagtttactgtgctatagtcgtaggtagcatttttgcgtttgatcttggtcaatcacgggcggcacaataaccgccactaacatagtggtgagaaaatatgtctatagatactgaatatcaaccaattaattgtgatgattatgataaccttgagctagcttgccagcaccagcttcatttacacatccaactgcaaggtggtgacgtatttgaaggaaaagctaataagctgattttaagaaaaaaagtcgaatatattctcgtagaatcaaatgaagaaacccgtgaattaaggttggatcacatcatcagtttcagcaacccagaaattggtacgattgttattgagcattgagcattgctcgtcctgaccgcgttcagaaagctcacattgatacacaaaatcacacacaaagtcctcatataaaatgagggctttcttttccaaatgactattttttatctacgtttggtttttccagctatgactccagcaattcgctcatttatcactgtggtataaatcaaatcccataatatatattcagtgaaggataaaatttaccctcagtaacctttaatagatactgaggataaattgatagattaagcatgatacgtaaatccagaatataagtgtttatggagacctttataggaggttgcgttaatttaaggctaaaaatgaccacttgctgaaaaaactccactaacggtttctgctcctactcctacaaaatttcccaaattattattatcatcatcataaaatataattgttgtagtaattgacaatgcgtagacccaacattgagttgtcttagcatcaagactatccaaatcctcatcatatatacctccaaatattccccaattcccaggctacccaacccccagttttttccagaaaatcctttgttataatcgtcaagttttaaaaccaccgtagaataaagggccagagtctggatagctatgttgcctcaagaaaaacttcattgtcattaataataactttttacatattttatcaatatctttagagggcaattttccattcatggaatcactaaaaaccttaacgatatccagtttcatttcatctgtaatttcaaaattttttctctttatttatttttcataacaaccaaccttattgcaaataaatacaactaacctaagataattagatagctattacattaaccacatataattaaaatatcattattttatttattataaaataattaaaatcattattatttattggagaaatactaaaaagcataaaactcagcaatagttatttaaaataaattaataatccgacagaatttaacttattctgtcttcacttattactgtgaatttaacattgaaaaagatatattattctctgtacaatatatcttaactcccccaacggtgtgctcccccctaaaagctattccgatataattgccactcaataaatcctattacactttaaaagatagtacattatgtaataatttcaattataaattacagaatttttaacaaatattttacacctgatttccaccaaacataactatgatattgaataaaaaagagattacataatttctaatgtaatctctcataggtattttttatattaaactgccagcaatgatgaattgctgtttcgtcagcgacaacttgaaagatgaaggatataggtacattaagcagaatacggcattctgtcccatttgattgaaagtatctcctctcccgccaaaggctgcccctccctggtgacaaaaacccccaatgctgcaatcaatgtttcatcataataaagcaatggtgttctttccctaagccaaggtgcgatacctaattcctgccataattttttactgtgccgggaatgcttacgacccacgatgctaatatttccctgtacaccaaaacgaatggttacccgctcatttctaccaggcattctgacattaataccactttcttctgacaacaccagcatgcccaaaccatcgggtaatcgcagttcttgtgctatatcccattcaagtagggttcctgccagcgattggcattgaggaaccagccagagttgttgccgataacggcgaacatcgtgctgccccaatctaaaacgtggctcggcatcctgtctggaaagcgccacttccgaccaaattctctggagttgttcacgcgcaggcatcttcacaccatgctgattgaaccatctgcgtaacaaagcattacgcttggcctcagagcaatccaccaacggtgaaatggctatcgcgccttccggggttatcagctcactcaacgattcattaagcaattcatccaacaattgttcttgctctccacacaagctggcactacgagaagcggcttgagggaaatgaggccagcgctggttaagcaatggcatgatatgcaaacgcaaaaaattacgatcataacgatcatcttggttactatcatcttcgatccattgcaacctctgtgtgtgtgcatacgtttcgagttctgcacgactggcattcagcaatgggcgaatcagtgttgttccagcaaatggcatggaaaaaggcatagatgatagtccggcagggccactcccccgtttcagtgccagcagaaaggtttctgcctgatcatcgagatgctgcgccgtgaccaaaatttcaccctgttgcaattcatgctggaatgcctgataacgggcgtcacgagccgccgcttcaatgccattttgccggatatccaggctgactttttcgacccgaaaatcgaccttccagtcggcacaaatctggcgacaatgttcaacccacttatccgcctttggatttaaaccgtgatggatatgaattgcccttagctctatttgatcacgaatgactttgtgggattggtaacgtaactgaaccagcaaatgcagcaatacggtggaatccaatccaccgctaaatccaatcaagatttttttatatcgccctagctgatcgattaacatcgttaacagaggctcatgaatattgctcattgtgagtgaaaaccttctttcatttggcgatatcaatcctcaatcaaatcatcgctcaatttattctgtgtcgctgtcttggtttttgcactgatgcagagcagccccgatatgataacaagcgctaatcccacagcataagcagggacaaacgcatcaccaaagaacagaataagccatatcatcgacagcaccggtgataaaaataagattgaggcaattttaggcgaatcagggctattcatagccttaaaccagataatataggatacgccattcaatatgatgccgttgagcagcgttggcatcagtgaatcacccactggccaattgaagctgctaaatgccaataaaaacaccgccgacactaaggtagagcaagtgaatacccaaaatgtactgatataagggtcaatcgcgaaatgtttcgatagcacggacatcaaggcaaaacaaaatgccccactggataccagcaacagagcctgcggatgttctactgcaatctgggtaatatttccttgcgtaaacgtgatcaaaacggcaatgaaaccaagcgtgatgccaatcatctgcctgattgataatttttctttgaacaggaaaaacgacaacccgatgatcatcagtggccagctatattgaacgaccaagacagcaaccccattctcgatggaataaccgtaatagagcaataaatagaagaaacagtccagagcacctaatatcaaaactttaagcataactggaaaggaaataaataaaagttgttttaaatttctccccatcaggatagcaacaaagaaaaccgccagaacggacagaatatttgaccagaacaaatattggaagtgatccatccctttttgacccaaacgggatatggagggaacaaaactccagatcaacacacaggaaaacgcataaatgatatatttatatttggccatagaaaaacccaatttattatttttcgagtctagctgataaaacagcctatttcatcccaatgttgtcagaatgataataccagacagtatggagcgtgctgatttcattacctataaacaataaaataggtggaaatactgaggttctatctctccccagtactgtccacctgcaaataacaatattaaaaataaagctggattgtaataaaaacagctttcaggacttagcagtaaccgtattgcattaaacgctcataacggcgattaactaattcttcgctgttcagatgatccaaatcggcaaaatcagccagtaattgcgcttttaatgcttgagcaatcgcgtcatagttacgatgtgccccgcccagtggttctggaataacggaatcaatcaatttcaactctttcagacgtggtgctgtattgcccatcgcttcggctgccagtggggctttgtcggcactcttccataagatagaggcacaaccttccggagatatggtagaaaaggtgctgtattgcaacatattcaccttgtcacccacactgagtgccaacgcaccaccagaaccgccctcaccgatcaccgtacagatgacaggtacggacaggcgggacatttcacgcaggttgcgggcaatagcttctgattgaccacgctcttcagcccccacacccggatacgcgccaggagtgtcaataaaggtaatgatcggcagtttgaaacgctctgccaactccatcagcctcagtgctttgcgatagccttctggcgatggcataccaaagttacggcggatcttttctttcgtctcacggcctttctgatgaccaatcaccatgaccggacgcccatcaaggcgcgccaaaccagcgactatcgccttgtcatccgcataggcacgatcacccgccagctcttcaaagtcagtaaaaacgcgctgaatataatccagcgtatagggacggagtggatgacgtgacagttgagatatttgccatgcccccagatcagagaaaatcttgcgggttaattcaaggcttttttctcgcagacgctggacttcttcatccagatttatatctagcttttcatcttgacggctaactgcgttgagcgaatcgattttcgcttccagctcagcaatcggctgttcaaaatccagaaaattcagactcataacgttcctattttagtcaaattctaattctacctgctcgttacccagcagagttcgcagatctgtcaaaagggtatccgtcggcgttacccgccatgttgcaccgaatcgtaaacgggcactggcatctactcgctggtaataaagatgaactggtatcgtacctgaacgatgcggctccaatacgccacggagacgattaaataattgttcattaatttgcctgtctgacaacgagatagctatcccgcgtgcaaatttttcacgcgcctcactgatatccattaattcacggactgtcattttaaggccgccgttgaagtcatcaaagctgacttgtccggtagcaattaaaattttgtcctgttccaataaatgctgatatctttccagtgcatcagaaaacagcatgatttccagccgtcctgaacgatcatccaaagtacagatgccaatccggttgccccgtttggttgtcaagattttggaggccagcaccaaacctaccacagtcgttacttgaccacgaggtgtcgggctcacatcttttagacgcaatccattcgtatatcgttcaatctctttcaaataacttgtgatcgggtgacccgttaaatacaaccccagcgtttcccgttcaccatctaacacgatttgctctggccatttcggtgtactggcatatgaaagctcaacctgttctggtttttcagccagtactccaaacatatctgtctggccaatggcttctgctttagcatgttggtcagccgctttcagcgcgtcttccaacgaagacatcaaggccgcgcgatgtggccccagcctgtcgaacgcaccagacataatcagcttttccatcacacgacggttcagctttttggtatcaacacgcgcgcacagatcaaacagttctttgaaatgcccctctttttgacgtgcttcgaggattgcttcaatcggcccttcacccacacctttaattgcaccaatgccgtaaacaatttcgccttcgtcattaacatggaagtgatacagaccgctgttgatatccggtggtaaaaccttaagccccatgcgccagcactcatccaccagcccaaccactttttctgtattatccatgtccgccgtcatcacggccgccataaattctgccggataatgcgcttttaaccataaggtttggtaagaaaccaacgcataggctgcggagtgagatttgttgaagccataacccgcgaatttctccaccagatcgaagatttttatggcgagttcgccattaataccttggcttatcgcgccctcttcaaataccgagcgctgtttagccatctcttccggctgtttcttacccattgcgcgacggagcatatctgcaccaccgagggtataacctgccagcacctgagcaatctgcatcacctgttcctgatacagaatgataccgtatgttggctctaatacgggtttcagggattcgtgctgccactcaacatctgggtatgaaagctcttcgcgcccatgtttacggtcgataaagttatccaccataccggattgtaatggccccggacggaacaacgccaccagtgcgatcatgtcttcgaaacagtcgggacgcaggcgtttgatcagatctttcatcccacgggattcaagctggaacaccgccgtagtttcagagcgttgcagcatatcgaaacttatctggtcatccagcggaattgccgtaatatcaatcggttccagatttttatgagtacgacgggcgttcaccatctcaagcgccgagttgatgatggtcaaggttctcaggccaaggaagtcaaactttaccagacccgcatattccacatcgttcttatcaaactgagtgacggggttcaggccttccggatcacagtaaatcggtgcaaagtcagtgatcttggtcggggcaatgaccacaccacccgcatgtttaccggcattacgagtgacaccttccagtttacgcgccatgtcaatcagcgccctgacttcttcatctgcttcgtagatttcaggcaactgaggctcagccgcaaacgccttttccaacgtcataccaggatcaggaggcaccagttttgatattcgatcgacaaagccatatggatgccccaatacgcgcccaacgtcacggataactgcttttgccgccatcgtaccgaaggtaatgatctgcgataccgcatcccgcccgtacatatccgcaacgtggtcaatcacctgatcacgtttttccatgcaaaaatcgacgtcaaagtcgggcatcgaaatacgttcagggttgaggaaacgttcgaacagcaaatcaaatgccaacggatcaatatcggtaattttcaaggcataggcgacaagggaacccgcaccggaaccacgccccggccctacaggtacgccattatctttcgaccattggataaattccatcacgatcagaaagtagccggggaagcccatctggttgataacttccagctcgatatccaaacgctcatcgtattcggaacgtttttccgctcttaattgaggatcgggatagagaaagttcaggcgatcttccagaccttgcttcgatttttcaaccagatagtcttcagtgctcatatcccctgttggaaactgtggcaggaaatattcaccgaggcgaatagtcacattgcagcgtttagcaatttctacgctattttgcagcgcttcaggaatgtcagagaatagctcgcacatttcctgttcactgcgcagatactgctgaaggctatagtttttagggcgtttgggatcagccatcgtatagccatcatgaatggcaacccgaatttcatgggcctcaaagtcgtcgctttccagaaaacaaacgtcattggttgccacaacaggtaggtttttttctgctgccacttcaacgacagcatgaagataattttcttcgtcttgacgcccagtacggatcaattcaaggtaatagctgtctggaaagtgttcctgatagaaatcgaggcactgatccaccatcgcccgattgccacgcagaaggaatttaccaacatcccccattctcccaccagacagaagaatcaagccggctttgtattttatcagccattcttgtttaatcgtcggcccaatcacgccataacctttctgataagcttcggaaatcagaaaagtcaggttttggtaaccttcgttattacgggcaaggatcgtcagatgggcatactcatcccccagcagatcactttccacataaaaatcagcgcctataatcggcttgatacctgtactatgggcactgccatagaatttcaccaagccgcacaggttagtaaaatcagtgatcgcaaaagcaggcatatccaatttagccacttgttttaccagtgaccctgttttggctaagccgtcaatcattgaatagtcgctgtgaacacgtaagtgtacaaaacgtggttctgtcatagtttgcccagattacttatccaagacccagcgctcgtttgaccggcgcaaagcttttacgatgatgtgccgtggcgcccagcaaagccagtttttccagatgcagggcggtcgggtaacctttgtgtttcgcgaaaccataatcaggaaattgcttacccagttcggccatttctctgtcgcgtgtcacttttgctaaaatggaagcagcacttatttctgccaccagattatcccccttaaccaccgcctgtgccgacattggcaatgcaggacaacggttcccatcaatcaggacataatccggtgtgatagctaaaccttccaccgctcgctgcatggcgagcatggtagcgtggagaatattgagttgatcaatttcttctggttcggcacggccaaggctccagcacagcgccttttctttaatttccagataaagtgcttcacgccgcttttctgtgagttttttcgaatccatcaagcctgtaatcggtttggcaggatcaagaatgactgccgcagtaaccactgccccgaccagtgggccacgcccaacttcatcaacaccggcaatcaaattcgcctgaggataaacaaaatccattatcttctcgctaattccagaaccgcttgtgcagcttgttcatcggcatcacagcgaatgctttcatgcaaatgcagaaacgtttgtttcaacgcttccacatcagcaccaccttgcaagagaggcaacaatgcctcagacaatgcttgtggctcacattcgtcctgtaatagttctttaactaattctttgcctgccagcaggttaggcagagaaacatacggcgtttttaccagccgctttgccagccagaatgtaaaaggtttcattctgtagcccaccaccatcgggcatttggccagcacacactccagcgctgccgtacctgaggccagtaaagtcgcatcactggcgatcatggctttaccggcgttaccatccaacaaatggacagataaatccggcgcaatctcatctttaatacgctgaaactgctgatgccgcttggcattcaccaatggaaccaatacatgcagatcaggaagggttttcctcagcaactgcacggttctaagaaaatcggcactcaacatctcaacttctgcatggcggctaccgggcagtatcgctaggcaatgggcatttaagggaacacccaaagcctcccgggctgccactttatccgtttgcagtggcatcgaatcagccatcgtgtggccaataaacctgcatggaacgctaaatcgatcatagaacgctttttcaaatggcaaaaatgccagtaccagatccgttgcccggccgattttgaaaacccgtttctgacgccatgcccatactgatggactgacgtaatgaatcgtcctaatccctcgctgtttcagccgcccttccaacgtgatgttaaaatcaggggcatcgataccaataaagacatccggcttcaacgcggtaaaccgtgccgttaaatctttgcggattttcaacaaacggggcaagcgtcccaatacttcaacgatccccatgaccgccagctcttccatctcataccaggcttcgcaaccttccgcctgcataagagggccagcaacacccacaaaatgggcatcaggaattttagctttcaatgcgcgaatcagcccggcaccaagaatgtcaccggacgtttctccggcaaccaaagcaattgtcagcggacgctgattactaacagaagaaaaggtagccaaaggagtatccttcatctacttaacgaatgatgccacggttggattttgctgaattttccagaaaatcactgaatgctttcacatgtgggttatttgccgcctgaagctcaatttctattctggcttcttccagcgtctttccgctacggtaaagtactttataggcattacggattgcatgcagtgattctttatcaaagccacggcgcttcaaaccttcaatattcaatccgaaaggtgtggcatggtttccctgtgcaatgacgtaaggcgggacatcctgcgcaacgccagaacaaccaccgaccataacatgagcgccaatctgacagaattgatgaacagccgtcattccaccaataatgacgtaatcgcccagaatgacatgcccacccagtgtgccgttattcgcaatgatacagcgatcaccaagcatgcaatcatgagcaatgtgggtgttaatcatcagcagattgtcactgccaattttagtcaaaccgccaccctgaacggtgccacgatgaatcgatacgctttcacgaatacggttacgatcaccaatctcaacgcgagtcggttcaccctgatatttgagatcctgatttacttcaccaatagaggcaaattgataaatctggttatcacggccaatcctggtgatcccgttgatcacaacatgggatttaacttcggtcccttcaccgatctcaacctgagaaccgatatagcaaaatgggccaatacggacattggcaccaataactgcaccctcttcaacaatggaagagggatgaataacagcagtttgatcaatcatatattaagcctcacgacggcgagcacacatcatttcagcttcgcaagccacttctccatcgacttttgctacgcccctaaaacgcgcaacaccgcgacgttctttaataaattcaacttccagaatcatttgatcacctggcagaaccggacgcttgaaacgagcgccatcgatagcggcaaagtaatacaactcacccggtgccagtgagccaacgcttttgaatgccagaattccggttgcctgagccattgcttcaaggatcaggacgcctgggaaaattggcttacccggaaaatgcccctgaaagaatggctcattaaatgatacatttttgactgcgcgtaggaatttaccttcctcaaaatccaaaacacggtctaccagcagaaacgggtagcggtgaggtagcaaatccaaaatctcttcaatttgcagagtacgattatcactcatctaaatactcttcctgtctatataagaatcatagtattaacgacacggcctgcgttaactccaaatgcagagttatcaggcaggccgcaaaaataaaaacataaccaaaaacgtttgtatgattactcgttttcaccttcaagctggcgttctacagatttaagccgtttattcatttcattgatattcatgactaaagcagcagttttacgccaaactttgttcggttgtaatgggataccagacgagtatacaccaggctctgtaattggacgcatcaccatgcccataccggttacggtcactttatcacagatttctatatgcccattaatgacgctggctccaccaatcatacaataacgaccaattttcaggctacccgccatagtggcaccaccagccactgctgtgttgtcaccaattatgacgttgtgagcaatttggcactggttgtcaatgataacaccattaccgataactgtgttatccagcgctccgcgatcgatagtcgtagaagcaccgatttcaacgcggtcaccgatgatcactgagcctaactgtggaattttaatccagttgccacggtcattggcatagccaaaaccatccgacccgatcacggtgcctgactgaataaggcactgttcgccaatttcaacgttatggtatactgatacattggcccaaaggcgggttcctgcaccaatacgcgtatttttgccaataaagcaacccgcaccgacaatgacattatcacccagaacaacgccagattcgacaacggcatttgcaccaaccgccacatttttccccaattgcacttcagaaaatatcacggctgatgggtgaatatcctgtgcaggttgtggcgtcgtatccatgatttgtgccatacgtgcataggcaagatagggattatcaacaaccagtgcggcgaccttacaatgagtaagatcagattcacgcagcacaacagccgcagcctgacattctgcaagtttgtcagtgtaacggctgtcagataaaaatgtaatttgttcgctatttgctgaatacattggcgcaatgctggtgatgacgatatcgccatcaccatgtaattgcgcattcaactgctgagcgagatcagctaatcgaattgaaaccatctacttatttaacctgtttcagtacatctgcggtaatgtctttacccgatacggaatataatacggtattagcatcaagaacaacgtcgtaaccttctttacctgcaaccactttaacggcatcgtgaatgcgggtcaggagtttgttctgctcttccatctggcggcgacggctatcgttatcaagagactgcgccttctgggcatagtcgttacgctgtgccatcacttctttctctaattttgtgcggtcgctggctttcatggttgaaccatcacgctgcagtttctgcaccttggcctgcatatcagcttccatactctgcaactcggatatacggcctttaaattcactatccaactgttttacagcagcttcacgagccggtaacttttggatgatttcaccaacgttcacgactccgattttgtctgctgcctgaacacccgcagagaaagctaatgcgataccaaggcttgccgcacacaatacttttttcactataaactcctttgacccacgctattttttacatgttggaaaattaacaatcaccttatctaataataaggcgattttccgccaaaaacgattaattactaccaagtgccgccgatgttaaattggaactgctccgctctatcaccttcgtattccttgattggcttcccataagagaaggtcaatggccccaacggtgacaaccattgcaatgcaataccggccgaaacacggatattatttggcttgctgtagtcaggcaggccagggtaaatcttgttccagttggtatcccacacggttcccgcatcaacaaagaaggaagtccgtacagtattggcatatttcgcatctaggaaaggggttggcgtaatcaactcgaagctggcagtcgctaacgcattcccccccacagcatcacgggatggactatttttttctggttctttgtccttacctaaataaatcgcttttggaccgatattattcgaacggaaaccacggacactattagaaccaccagcatagaagttttcgtagaatggcatttccttgccacctaaaccgccaccatagcccatgcgggtgcgccccatcattacccatgaattcttatcatcaatcggataataacctgtagcgctccaagtgagtttatagtactggttgtctgagcctggcagagccactttggcatccactgaagacttgaaaccagaagttgggaagaaaccacggtcaaagttgccatatatccaactgaatgtcagtgggaaatcattggaatcgaacgatgccttgccctcaaaaggcggctctttgcccatttttttcaaataacgccacatcgctgcctgtggacgcatgtcagacagtgagttatgggcatagcccaatctcatggccagcctgttattttcatttagcgggaagcccaaaataccttcagtaccgtaggctttattggtataaccagaaagttcagcatcatctgcacggaagtcgttatagtacacacgaccgcccagacttacgccattcactgtgaagtaaggatcggtaaaggacaaatccgcagaggtcgaatagtcatttttgctggcactgatccctacagagttacccgttcccagccagttttcctgctgaaggccgatctggaagctcatgccactttcagtaccgaaaccaacaccaaagttcatggaacccgtattgcgttctttgactttataaaccacatcaaccaaatctgggctgccggctacacgttctgtatccacattaaccgtttcaaaaaagcccagtctgtccagacgctctttgccctgttcaacacgatcgctgcctagccatgccccttccatttgacgcatttcgcggcgaagcacagagtctgtgctaacatcattaccttcgaagcggattttacgcacatagaaacggttacccgcatccacattaacatgtaacttaaccgttttgtctgtatcgttgatttcaggctgtgtaataactcgcgggtaggcatagccatagcgaccaagcaggtttttaattgccttttccatcgaggtcacttctgtaccgttatacagcgacccaggctgaatgttggtcagttttgtggcttcagactgataacctgccaagttaccgttcaaatcaatactggcgatcttgtactgagcgccttcattgatattcacggtgatatagataccttttttatctggcgtcagattgacttgagtcgaatcaatactgaaacgggcataacctcgatcaaggtagaaactgcgcagggtttcaaggtcacccgccaatttctgtttctggtatttctggtcagacataaagttccaccaaggaatatcatccctgagctggaagcggttgagcaactcatttgtagaaaatgctttattgccgacaatattaatctgctggatctgagctgagatcccttctgaaaatatgagtttcagatcaatacggttacggggcagcggcgtgacaacggcttgcaccgtagcattgtatttaccaacactgtagtaaaaatcttccagccctttttccatattagacagcatggtacggtcaagagcttcaccaacactaacacgagaggactcaaggtttttcttgagcatgtcatctttcaccgatttgttaccggagaaagtaatgctggcgatggttggccgttctttaacctgaacgacgagtgtattgccatcacgcaagacacggacatcttcaaagtttccagtcgcgaacagtgtatgaatcgtgcgactgatatcctcatcgctgattgtatcacctacgcgaactggcatattcagtaatgctgcaccagaagtgacacgttgaagaccctcaaactgaatgtcccgaaccacgaatccgtctgaactgtatgcagtggcgctgccgaacagcagcgacgctatgagcaactttttcatcgccatcgttgttatgcgttttcctaaccggtctcccaccttagaagcgggagaaatcattgaaaagtgcaagccccattaataacaccagtaatatagtaccaatgcgataactgaagtcttgtacacgctcggagactggccctcccttgatcttctcaatagcaaggaaaagcaagtgtccaccatctagtacgggtaatgggaacaaattaatgatcccaaggttgacgctaatcagcgccaaaaacatcaaataatacaccaagccagaatcagccgatactccagcgcctttggcaatggaaataggaccactcaggttattgagtttcacatcccccacaattaatttaccgatcatattgacagtcagcttcatcaattgccaagttttgtctcctgcctgataaatggcagagaaagccccatattgttgaattaccttatattcatccgccagtggaataacttgaagttcggcgccagcgaagccttcttcacgcccattggacaaccgcctggcctctggtgtcaaagacagggggattatgctatctgccctcgcaacgtccaattttagaggaacattcggattcttcctgataaaagatacaaaagtgtgccagacatccacattctggccattgactttaacgatcctgtctccacgttgtaaacctgctttttcagcaggagagcccgggtaaacgttctctacctgagagctgattcgtggtacgacaggcataatacccaaagacagcaagacatcctgcttggatggatcgaatgcccagtcacgtaaatctaatgttttttgcgtgctggcagaagcacccactggcatcacatccattgacacaaaagattcacccactttactcactaaggccagacgtaccgaattccaatcaaaggtttcgataccatcaaccatttttagttccattccgggcaaaatatttgcctgggcggcaatagaatctggcttaacatccaaaaccaccgggcgcacagaaggcacgccaatcacaaaaaccagccaataagcaatgactgccagaataaagttagcgattggcccagcactgacgactgccgcgcgctggccgatggttttattgttgaatgccatatgacgacgttcgggagagacagactcaacccgctcatcaagcattttgacatatccccccagagggataagagcgataacgtattcggttccctgcttatctgtgcgacgccagagcgctttaccaaacccgatggaaaagcgttcaacgtagatgccataccgtctggcaacccaaaaatgaccaaactcatgcactgtgataagaatacccaatgcaacaataaatgcagccagattccagagaatatccattacgtaccctcagagaccaaatccagaagaaattaacagtaccaatcccgcgaacacaggaactgctgctgtcaggctatctaccctgtccataaccccaccatgcccggggatcagcaggctgctgtctttgatgcctgattctcttttgaacatactctcggtcaagtcaccgaagacagaggcaatcacaaccacagccgaaatcaataataagttttcaggcattaccggtactggcgcaaatttaccgaacaaccacgaaataagcgcagcagtcaatactcctccgaccaaaccttcaagtgttttgcccggagacactctcggtgccattttgtgcttacccagtgtccggccaaaaatataggcaccggaatcggctccccataccagcagcatcgcatacaatagccaccatgcaccatgataggggttgttttcatatccctgagttcgaagcagcatcattccgcaataaaatggcacgatagtcagaacgccaaacaacaggcgcagtgcagttgatgacttccagattgaggcagaagcaggataagtgatgaccaacaggatagccgcagcccaccaaatcatgccagcccacaatagatatataatctgtggtttttcaataagatggaaaaaatctgacaaagaatactgtaaggccagtagccctacggcaaataacacggccaacgtaatacgtttagcttgtgtgaagaggccagcaaattgcccccattcccatgcggcaagtactgatactgtaataacaaccaatccaaacccggatggaggaagtaaaaacagtgctgcaataacaattggaattaatatcaacgtagttaaaagacggtacttcagcaagttttcctcctatgatcccacttcggcatcgtctggtattgttccgccgaatcggcgttctcgtttaacaaaggcattaatggcaccttcaaaaacagtttcatcgaaatcaggccaaagtatatcggtaaaatacaattctgcataagctatctgccataacagaaaattactgatacggtgttcgccgcccgtcctgatcaccagatcaacttcaggttgctcactcaaattgatgaagctgcccactgtggcttcagtaatttcctcgggctccagctcattcgccctgattttttcagcgatttgcttaacgccctgagccaaatcccaacgcccgccataattggcggcaatattaagctgcaatccggtattgcccgccgtcaattcaactgaacggcgaatacgttcctgcaaccgtgagctaaaccgactgatatcaccaataacagacaatttcacattgtgcttatgcaagctcttcacttcattatcaagagcaaaaacaaacaactccattaatgaactgacttcctgctgtgggcgattccagttctcactgctgaaagcatataacgtcagtgattcaatattgtgtttaaccgaaaaactcacggcaacccgcacagctttaacaccggcgcgatggccaaaaacccttaacttcccacgttgttttgcccagcggccattgccatccataataatggcaacatgtctgggtaacgttagcaatgagttacagtcactggaagatatcactcaaaatgatccttaaataactaagctggttcttctatgggttcaaatactttcaaacatgaaaaagccgtgtcaacaattaccacggctatttctggggcatggcccgaatgaaagcctctatctttggcacacactcggaaaacgtgtgacaaatattgaaccggctattataacaactattatttacccgcgaactataccatttgccaaaacgcaaacaaatatatacttattagcaagattcgctatttggaaaaggtcttaatcgtttcttttactaattttctagcgactttatcgatttctaagacctcttcgatactttgaggttcagacaaatttaatttttcgacgaccagccgattaatcatcacgatatcggtgaaacggatcccatctttcaagaaagcactgaccgtctcttcattggcggcattcaacgcggttgttgccgcctgaccttcatggcaggcatcgatggccagtttcagacaagggtaacgccgataatccaacgcttcaaaagtgagtgtgctcagttcagtaaaatccagaggttttgcaccagaagcaatgcgattaggataagccattgcataggctattggggtacacatatcctgcgttcctaactgagcaatgatgctgccatcctgataacgaaccatcgaatggatcactgattgaggatggagcagcacttcaatttcatcagcagaagcattgaacaggtaacgggcttcgatatattccagccctttgttcatcatggttgcggaatcaacagaaattttgcgtcccatagaccagacggggtgagcacaggcttcatcaggtgtgacatcaagcaatttctccaggggggttctgcggaacggcccacctgatcccgtcaggataatactggagataccatgttgttttaaacttgcatttccaagattgtgctgaacagattcaggcaagctctggaagatggcattatgttcactatcgatgggcaacagttgcgcttgatattgattcaccgcctccatgaacaaacgcccactggtaatgagtgattctttgttggccaacaagacttgcttacctttgcggatagccgccagcgtcggcaataacccggcaacaccgacaatcgcggacatgacttgatcaacatcgtccaacgcagctaaatcacaaatggcttccctaccggacaacacttctgtctggcttccctgctcttgcaataactgccgtaataccgttgctgagtgcgcatccgccattgccgcatattgagggcgaaactccagacactgctgtgccatgatttcaatatttttcccagcgacgagtgccacaacttggaatttatccaagttatttctgacaacagagagggtacttttcccaatcgaacccgttgagccaaggatagttaagcgtttcattttaatactctgagtattctactgacataaaatgtcaatagtttgagccgtcccgatcggtatgtccatcgcttgagaaagaaatgtgatgcaaagaataacgccgcaaggactgcggcgttatattcgtgaaatggcaattagaaatccatcaattcagtttctttacttgccaatgcttcatcaattttcttgatgaaattgtcagtcagtttctgaatttcgtcttgtgaacggcgttcttcatcttcactgatttctttgtctttcagcagtgccttaaccttatcattggcgtcacgacggatattacgcacggacacacggccttgttctgcatcgccacgcacaactttgatcagatctttacgacgctcttctgtcagtgctggcagtggaacacggataatggttccagcagaagatgggttcagacccagatcggaagccataatcgctttttcgatagcaggcgtcatggaacgatcaaaaaccgttatcgctaaagtacgtgcgtcttcaacaacgacgctggcaatctgacgtaatggggtcgcagagccgtaatactcgacgttgataccatccagcaggctgggagaggcacggcctgtacgaatcttactgatttggcttttcagtgcttcgacgcttttttccatgcggtcttgtgcgtctttcttgatttcattaatcacgttacaaacccttgggaactggttattttgtagcccacgaatatcaaaataagatatcatggccctgtatcattaagtttggagcatcagtacgctgatcataccgtcaaatttcatcggtgtctctgagcattatccgtgagaaatcaacgtaccttcactttcccccatcacaacacgacgaagtgcgcctggcttgttcatattgaagacacgaattgggatactatggtcacgagccagagtaaaggcggctagatccatgactttcagttcacgctccaatacttcctgataagtgagcttactgtaaagaacagcttcagtatctttagcagggtcactagaatagaccccatcaactttggttgcttttaacacaacatccgcttcaatttcaatgccgcgcaagcatgctgcggaatctgtcgtaaagaatgggttgccagtacctgcagagaaaataacaacacgaccgtgacgcagtaagctgatagcctcagcccagctataattgtcacacactccattcagtggaatggcagacatcaaacgagcgttcacataggcgcggtgtaaggcatcgcgcatcgccagaccgttcattacggttgccaacatgcccatgtgatcgccgactacacggttcattcctgcttcggccagaccggctccacgaaacaggttacctccgccaataacgacaccgacctgaatacccagctcaaccagttctttgacttcctgagccatgcggtctaagacgctggcatcgataccaaaaccttctgcgccttgcagggcttctccactgagcttaagcaggattctctgatatacgggttttgcattggttgccatggtgttcagtcctaagcagataaggatattggggatttattacaattacacatccatgctatgcagcccagatgtaaaaattcatcatgaaataaaacagaaccgccaatcggcggctccgttcaaaacattaagactgcttgctcattgcagcaacttctgctgcgaaatcagcttcaactttctcaatgccttcaccgacttcaaaacggatgaagttgataactttagcattattttctttcatcaggtcaccaaccgttttgcttggatccatcacgaagttttgacccgtcagagagatttcgccagtgaatttgttcatgcggccagaaaccattttctctgcgatttcgcgtggtttgcctgattgcattgcgatatccatctggatctggtgttcacgcgcaacaacatcagcaggaacgtcagttgggttcacgtattctggcttacttgcagcaacgtgcattgcaacgtgcttgatcagttcttcgcttgcgccttcagcagcaaccagaacaccgatgcgagcaccgtgcaggtaagaacctactgcgtcaccttccaggatagttacgcgacggatgttgatgttttcaccgattttcgctaccaggttagcacgctgttcttcgaactgagctttcagtgcatcaatgtcagcatttttgtcagccataacggcagcaatcacttctttaccgaacgccaggaagccagagtctttagcaacgaagtcagtttcacagttcagttcaacaatacccgcatatttagcgtcagctgcaacttcaaccaggataacaccttcagccgcaacacggcctgctttcttagcagcttttgcctgacctgatttacgcatgttatcgatagccagctcgatatcaccatttgcttcaaccagtgcttttttacattccatcatgcctgcgccagtacgctcacgcagttcttttaccagagcagcggtaatgtcagccatttgttttattcctcgatgtgtctcgcgggaagataatattccgcgtggatagttctatatcagatatgtaaagggggccgtgacaggccccctaaccaatatatttcaatacctggtcaataagggctcaagaatgagcatgccttattattcagcgtctacaagaccttcttcagcttgaacagccagatcttgtgaacgaccttcacgaacagcagtagccacagcgcccaagtacagttttactgcacggattgcgtcgtcgttaccagggatgatgaaatcaacgccgtctggatcagagttagtatcaacgatagcgaatactgggatacccaggttatttgcttctttgatagcaatgtgttcgtgttcagcatcgataacaaacagagcatcaggcaggccgcccatgtctttgataccgcccaggctgttttccagtttgccaagctcacgagtacgcatcagcgcttctttcttggtcagcttgtcaaaagtaccgtcctgagactgaatttccagatctttcagacgcttgattgactgacgcacagttttccagttagtcagcataccacctaaccaacggtggttaacaaagtattggtcacagcccagtgcttcttctttgattccttcgctggccgcacgcttggtgccaacaaacagaattttgcctttacgggaagcaattttgttcagctctgccaatgcaatattgaacattggaacagttttttccaggttgatgatatgaactttgttacgagcgccaaagatgaaaggtttcatttttgggttccagtaacgagtctggtgaccgaagtgaacgcccgcttgcagcatatcgcgcatggaaacagttgccattttaaacctctataaagttaattggggttatgcctccacagatcccataacaccgactctttgactgcgaagctattcatagaagagcgaaccacatgagagcaccccggtatatgtgtcgatccgtgtgtgttatttacacaaatgagttaatttagcatcgctgaaaaaccgaatctggcagaaacaattatgcagaatgccggcgcgctttataccacaaatagcctccaaactccaacatttgttaccgctttctggtaggcagatctgtcaacggttattggcagatattctgtggactgataccataactaccagcatttttccttagttaacatcaaacagtcgggtaaatttccgacttgaatggaccgatttcatggctatttctatcaaaacagatgaagacatccagaaaatgcgcgttgccggacgtctggcagccgaagttctggaaatgatcgaaccttacgttaaggttggtgtgaccacaggtgagcttgatcgtatttgccacgatcacattacccataaacagcaggcaatttctgcctgtcttggctaccacggtttcccgaaatccgtatgcatctccgtcaatgatgtgatttgtcacggtattcccagcgatgacaaggcgctgaaagaaggcgatatcgtcaacattgatgtcactgtcatcaaagaggaatttcacggcgatacctccaaaatgttcattgtcggcaaaccgactattcagggcgagcgtctgtgccgcgttacccaggaaagcctgtaccttgcgctgaaaatggtgaaacccggcatccgcctgcgcagccttggcaaagcgatccaacagtatgtggaagggcaggattactctgtcgtccgcgaatactgcggccatggtatcggcagggtcttccacgaagaaccccatgtactccattatgatgccgatgatggtggcgttgtattgcagaaagggatggcgttcacgattgaaccgatggtcaataccggcgattcccgtatccgcaccatgaaagatggctggacagtcaaaaccaaagaccacggctggtctgctcagtatgagcacaccatcgtcgtcaccgacaatggctgtgaaatcatgacattgcgcaaagaagaagaaccccatatctcagccgtgctgattaacgaataattgcctgctggcgcgatttagcaatcattggcagaaatcacgtagataagacggcgttgataatcgaagcccttgtacataaactgtccccaagggcttcattatctgccaataacgtctgttcatctcacgtttttctcatcataggtttctgcatatgtcagttgatatcacctttgcacacgcgcccattcctcccctctctcctgcggaattttccctcaatgatcttcaacgcccggcattgaaacagcatgttgatgaatttcaattgtggcttcagcaggcattcaaagcggggatctcgccagaagcactgatttcagcccgcagtgattatattgatcgtctcctgatgcgcctgtggcaggcttacggtttcgatcagctcacttcactttccctgattgcagtaggtggttatggccgacgcgaattgcatcccctctccgatattgatttattggttctcagcgagagccaactgactgaagatcaagcccacaatatcgggcaattcataaccctgctctgggatatccgtctggaagtgggccatagtgtcagaacctttgaagagtgcctgcatgaagggttatcggatttaaccgttgccacaaatctgattgaatcacgtttgatctgcggtgatctgcctctgttcctgcggttacaaaagcacattttcagcgatgacttttggccttccgcaacgtttttcgcagcaaaactccgcgaacagtgggaacgccaccagcgttatcacagcaccagttataatctagagccggatatcaaaagcagccccggcgggctccgggatattcataccctgctttgggttgctcgccgccattttggggcagcttcgctggatgaaatggtggatttcagcttcctgacccgcgaggagcgcaatgaattaaatgaatgccaggattttctctggagtatccgttttgccctccatttggtcgtcacgcgctatgacaatcggctactgtttgaacgtcagttcaatgttgcccaattgctcggttatgaaggagaacgcaatcaacctgtcgaacggatgatgaaaaatttctaccgcgtgacccgccgtgtcagtgaattgaatgacatgctacttcaactctttgatgaagcgatcctgacattacagcccgatgaaaaaccacgtcccttgaatgaagcgtttcagttgcggggagatcttatcgacttaagcgatgaaaccctgtttatccaagatccaacctcaattttaaaaatgttttaccacatggctgaacatcgggaaattaaggggatctattccacgacattacgccagcttcgctacgcccgtagaaacctcaaacatcctttgtgtgagttgcccgaagcacgaaaacttttcatggatatcctgcgccatcctcgtgccgttaaaaacgcactgctcccgatgcaccgtcatagcgttctaggtgcttatatgccgctctggagtaatattgtcggccagatgcaatttgaccttttccacgcttataccgttgatgagcacacccttcgggtactgcaaaaactcgaaagtttcgccgatgaaaacaaccgtgtgatccatcccttatgtgtcgaactgtatccccgcattcctcagccggaactcttacggctggcggcctttttccatgatatcgccaaggggcgtaatggcgatcattctgaactgggcgccaaagatgcgtttacatttgcacgccaacatggtctgactacccgtgaggccgaattagtggaatggctggttcgcgaccatttgctgatgtcagtcaccgcacagcggcgggatattcaagatcctgacgtcatccagcaatttgccggccaagtcaaaaatcaaaaccggctgaattacctgctctgccttaccgtcgcagatatctgcgccaccaactccaaattgtggaacagttggaagcagagcctgatacgcgaactctatttcgccactgaaacccagttacgtcaaggtatacagaatacgcctgacttgcgtgaacgtgtccgccataatcgtttacaggcattagctttactgcgacaggaaggaaccgacgaagaacaattacacaatatctggagccgctgccatgcggattatttcctgcgccatacgccggatcaactggcctggcatgccggccatttgatccaacatcaatctgcgcagcccatggtgttaatcagcaccgcattttcccacggtggaaccgaaatttttatctggtgtcaggacagaccttcgcttttcgcggctgtagtcggagagttggacagacgtaacctcagtgtccacgatgctcagatctttaccaatcgcgatgaaatggcgatggatacctttattgtactggaacccaatggtcatccgctggcgctcgatcgtcatgaacctatccgccgggcattattgaaagtcgtgaacgatccgcatccgaaagcgcccaaagcgcgtaatcttcccgctaaactgcgtcattttgatgtgccgaccaaagtgagttttttaccagcacaaaatgtccgccgctcttatatggagctggttgcactggatcaacccggtctgctggcacgcgtgggcaatattttcgccgaactgggcgtttccctgcatggcgcgcggattaccaccattggtgagcgcgttgaagacttttttgtgctggcagataaagaccatcaggagctggataacaaaatcaagggagaattatcagaaaggttgacagaaaccctcaacaccaaggataaagtataacaatattctcaatttgactgacaattaggaacaccatactgatgcagcaattacaatccattatcgaaatacaagccattatcgacaatgcgtttgaaaaccgcactgacattacccccagcactgttgatgaagcaacccgtgacgccgtcaatcaggtgattcagatgctggacagcggcaaattacgggtcgctgaaaaaatcgcagggcaatgggtaacgcatcaatggctaaaaaaggccgtattactctctttccgcattaatgacaatcaggtcatcgaaggggctgaaagtcgctatttcgacaaagttccgatgaaattcgctgattatgatcaagctcgtttcgaaaaagaaggttttcgcgtcgttcctcctgccgcagttcgccaaggcgcctatattgcccgcaacacagtattgatgccatcttacgtcaacatcggcgcttatgtggatgaaggtacgatggtagacacttgggccaccgtgggttcctgtgcacagatcggcaaaaacgttcacttgtccggcggtgtgggcattggtggcgttctggaacccttgcaagccaatcctactatcattgaagacaactgctttatcggcgcacgctctgaaattgtagaaggcgttatcgtagaagaaggtgccgtgatctcaatgggggtttacattggccaaagcaccaaaatttatgatcgtgaaacaggtgaaatccattacggccgggttcctgcgggttctgttgtagtatcaggtaatcttccttccaaagatggcagttacagcctgtattgcgcagtcatcgtgaaaaaggtcgatgccaaaacacgtggtaaagttggccttaatgagctgctcagaaacatagactaaattttaaaatagcggataataaatccgctatttttttgatatctctattttttagcactcaattaggtgaggcgctctatgtacgataacttgaaaagtttggggatcacgcatcctgaagatattgatcgctatagcctccgtcaggaagcgaataacgatattctgaagatttatttccgtaaggataaaggcgaattttttgccaaaagtgttaaattcaaatatccacgccaactcaaaactatctctgacgacaattcagcgcaaggttacaaagaagtcaaagagattaacactaatttgcgttatgtgattgaagaactggatcaaatttgtaaacgtgatcaagtagaagtggatttgaaacacaagatcctcgacgatctccgccatcttgagcatgttgttgccaataagattgcagaaatcgaagcggatttagaaaaactgactcgcaagtaatcacgccagccgtgtcattacaccgcttatcctgctcggcataagcggtgtgacatctattctgtcagtaaagcgccccactcctcaacccagttctgggcaaagacttctggttcaaccacgtcaataccatcaatcagcaggacttcgcccacacgctttgctccctgttcctgtaacagtttgtcaaatgtgcggccaccgccacaaaagaagtcatagctactgtcaccaagagcgataacgccataacgtaagtcgggctgatggcccaacttatcattcaaatctgaataaagtggctggatattatcgggtaattcaccctgtccggtcgacgatgtgaccaccaggacaacctgttgcaggtatttctgccactgcgtcaaggtcgcatcttcaaaaacctcaacttcatgcccctgctgctgaaggatctgtagcgcctcttccgcaactgccagcgcattgccataaactgtaccaacgaaaacaccaatctttgccataaatattgatctctttagcctgtttgtactgcgttcattcatgagtggttggacattccaactcaggtaaaataccctgccagccaaattgctccagcaaatgctgccacgaagcttcccaccgggctgtcagaagaagattctctcctgtcacaggatgcgccaattggagttgactggcatgcagcattaacctgccagtctgataatatttaacaactccgcagttttgtcgcagatcgccgtgtgtggtatccccaatgatgggatgccggagatgcgacatatgccgtcgtaattgatgcttacgcccggtttttggcatcagctccagcaggctgaaccgtgatgttgggtaacgtcctatttctaccggacattcaacttttgccaatgaacgatagtgagtgattgctgattgtgcttccctgtcagtatcagcgaatttatcagcaattttatccagctcttccattagtgcgtagtcgataataccatcaccttcaacataaccgcgtacaatggcgtgatatgttttttgtatatggtgacattcaaattgttgggaaagcgttcttgccacctcacttgacagcgccatcagcaaaacgccggatgtcggtttatccagtcgatggacggggaaaacatgttgcccgatttgatcacgcagcgtctgcatgacaaagaccgtttcatggcgagcaagccagctgcgatgcactaaccaacccgcaggtttattgaccgcaacaatatgatcgtcctgataaatgatatccagcatatcaaatatcctgtgtaaacaggctgtccaattcccgaagatgttcaagcagcggtagataacgttctgcttcttccttataggcttcttcgaaataaggtgtgatctcaaatgccgtcggcagattggcgttttgttctatcatagctcgcattcttggaattaaaacccactgaagccactcttctgcggacatcgtatctagcgaaaagggctcggtgctttcaaaagcttccggcttgggaggatggcttcgccacaggccagccgcgttcatgtcagcttcaattagctgtaatttaagtagaatttgttgttcgatattcatgatatttcgtctgatacttggctattgatcagatgacagaagctgccaccacgtcattggggcagtaagagtatcactgatatgatttcatcggaaaacttgcggcaggataaaatgaaacaaaaagaggggagataaaatctcccctcttactgattgtcatagcaatccggctaaattggtcgctccctgctcattccctgacaaaatacgtccctgtcagttattccttacaaaatcattatattgatagtattggcgctcctgcctataccttatcatccttgaagccacttcctgttggtatcattccctggttatttttttactgtggttccttacagaacagtgaaaggatctattattcagagagttgaaacaagccacctgaattggcccggtaagtaactttacaaaatggagatcgtgatcatcattttcatgctattgatataaaataaaaataatattcgcaaatgatattcatttcatgattaatagagatatctcacgtcccatgtgagacatctctcacaaaaaaacaaactgatgtctgcacctacaacgatgtggctggcttgataaccgacagaaaactcgccaaatcagcagataagatcgcccgcttaggtttaccagactgttcaagaatgacctgcccagtcaaattacacacagatatcatgctcatctccgaatcaatcgtcgcaataaatgccgtcggggaaagcttaagccgtttctgggtcacgagatgcccaatcaggttttcctgcaaacggataaaatcatcgtcactccatacctgaatcaggctgagattctgcccctcaaaactggcgggcatgtcaccggcgagctgcgtaacatagtaatcatgaatcgaatcctgcaagcgaatgtccagcgcggtttccactttgctgagtttttcgtgaacagaaaacagcttgggcaaccagtacaccacaccatcccctgtccgctcaatacacgaagaagggataccataaaggtcactgctggctggcggcagccctgtctcctcctgccacaattcaacataacgtcgggtaaaatcagtaagtgcttctgccacattgaaggtcatagagttctttcatccatcatttttaggtttatacctgtcgtcttacaagttgccgctttgttggctacgttcactcaccccaatcacatagttatctatgcgcttggggattcgttcccttgccgtcgcgctgcatcttaaaatccattgggtgtatatagttttcagcaaaataacaaccggaaaatgagatcataaatggatattcggtacgcgaacagtgcattcgcttcgccaaaaaaggagaagccagactagccgacttctcccgtgacttcatggtgatcttactgatcagcacgcggcttccgacatgaaggttatcctacatgggcggcggttcgattctgacgaaaaccggcttcgtttccactacaccaaatgcattttccaccttcagtttataccagccggaatctgctgatctggcgggtttctcgggcgaaccaaagatgaggatcgaggattttttcccactggtgaagctccagtcgcctcccgatgagtaattaccgtccggcttgtctttgcaccaaacccattcgtaatcattctgatcatcgaagctgacattggccatgatcccatagccatgactattgagatcgatgtgcatgttttcaccccccttcggaatttgatatcgcacgacaggtgggccaataagcgtaacctgatcaccactatacgttccggggtaaggcgtaccatcctcttgcgtacccacaaccccatcgcccacagcgggtaaaaccagtaaagcgtagttacccgatgtatatacggggatgaccaccgaggtcgtttcgtaagaggtcggagcaacagaagtgccctcgcaccccgcccaatagaaaggaacatggtcagcaggcatatagaatagcgtatagcctttgatcgttccggaaatgggtgattcagaattcttccatgaaactttaaccattccgggcatacccggctgttcactaatcgtcagatgcgtcggcagggaaacagtcggggttgttctgacaaagaagttactttggactcctggcagtggcttgccattttctcccgccccaaatactttcccatccccgaccgggagcaccgtaatatcccacagctccctatcgctgtgcgggtgcgttttatcaagcggaagttcgtatctgtgagtctgaccggaaggtgtgacttcatacgcagtcgcgttgtcccaactgtcaccctcactcgcttttttatagaagaaacggtacgaatcaaatgcattacaggaagtggggaccgtacccgcatcatctgacagcacggcctcgcggctgaacggctctcttgcgagacgttcaaaataactacaattatttaacagatgaagcgcagttactagttgatagtttgactccgagatgctggctatcagctgtggcatcaagagaggctcaataaaatctcgatgatccgatagtagcacaaaatctccctcagcctgaagaggctccccacctacatgcagaccaacaaccatttcataggaacgtgggccgatgtcgatcgggtaacccaagagcaccggcccgccggaatcccctgcctctgaaactccactgccctgtcccacatcatagtgaactaataattgctgcgttgggggatattgtggatctggatatacgcgagataccgttccgaatgcggttcccaaacggtaattgtttgcatcagcatacgcgtacagacggacacgtatgccgatcatgccttgagcagaatgcagtagattaacaggcgcatagtcgttcagtctgtagggcgcagtcaatcgaagcgcggcgatatctccgccgtttggcgaaaattcaatcgcatcgatttgcagcataacttgagagacgggtgtgccgggttcttgagtcctgtaaaagcccctaacggacacgtcttctggcctgacaggcctccccccttgctcgacagcatggcgggcggtcaaaagccacatatccgataccaaaaagccagtgctagagtgcacgtaatcaggacacactgcaccgtgctcatcacgttcttgcctaataatttttacgacccacgggatatggggggcatcaggtcccctgaacacaaacacacccggacttgctttttcaacagggttatttcggcttgatggcaagcccatgtcattatagttactattcataacagttaccgccataataattacaatataatatgatcactataaataatagttgccattcataaaatgatccaaaaaataatgcgatgagcggattgggtcagaaatcagctgacgaaaaagcatttctgcgttgtcgcatgtgcattggcaaacaagttagctcggatagcctaggccataacaacccgtcaaaccgtatttgaaagataacgataaagttaccctaatcagcaactttatcgttgatttaaatagttaccatctggttttgcgaagactgattattgatgacatgaacggcttgatgacaaacctaacataaaaaatggctctttgaagccgaacagatttttaggtacatcagacacggaacccatcaaggcgcaggcatccttgcctagagtgatgccggatagatttacgcaagccaaccatacatcaaaatgagtattgcaaaaactgggggaaccatagattttgtgctctcccggaaaatgatgccataatctcataaattaattcaaataaattaattcaaataaattaatcacgaccataattaatataaaaaacaaataagataataaaagcggaattatcctgttaatattaatcgagtaacatcgaacctctttcacaaaaaatatattacaccccgttagaaaaaaattctttttttatttacacccgaaaaagaatccaaactaataatttcattattaaggttataaaaaatatgaactcatcaaatataatgagaaaagagaatattttagctagtgaatgtccccatgttaaaccagaatataacttaatcagctttcccaacgggataaaatgggaaaataggcattttaagaattggtcaggtgaaattgagcaacataacattccctgttgcataccacgctctgttgaagaaattcttgccgtcgttaactgggcctggaaggaaaattataagctgagacccgttgggcaatctcataattggtcgccgctgatacttccgcaaaaacagcggcctgaatcccgggttatgttaatggatctcagccagtattttactcaggtaagcatcgaacaccgctcgcagttctctatcgttacggcacagactggcatattgatggaaacgctaatggctgaaatggagaaacacgggctaggctttaccgcaacccctgcccccggagatttaacgctgggtgccgttctggcaataaatgggcatggaaccgcaatcaaagcactcaatgaaacatgcctgcctgggtacacttacggttccctcagcaacacaatattggccttatctgccgtcatatgggatacagaaagccagcaatatatcattaagcgttttgagcgacatgaacccagctgcgcttctctgttaacccatttggggtgttcaatggttttggaagtccagcttcaggcaggccagaatcaacgcctccggtgtgaaagttttactcacatccctgctgctgagttgttttcccctgtgcaaagcaaaaatactcagaggactcttagccactttcttgataaaagtggtcgggcagaagttatcttatttccatttaccaataagccctggttaaaggtctggagtgttgcaccagagaaaccggcttccagcgttgaagtgacagaaccttataactatccattttccgataatatctcatcttcgttatctcaacttgtcaacgagatgctttctggtattcctcagctaacgccgtctataggcgctctgcaatataccttggtgaataccactctgccaaagaatggaaaagatatctggggctggagtaaaaacctgttgctatatgtgaaacccacgacattacgggtgacagcaaatggttatgcagtattaacgcgccgggcagatattcagcgagtgctgcatgagttttattctgaatggcaatccttgatgaaagagtttcaatataaaaatcaatacccaataaatggccctcttgaagtcagggtaaccggattagacacgcctgaagacgttatgcaggaagccgctgtcgtgccaagtttgtctgccatacgcccacgtttggatcagcctcattgggatgtcgctgtttggctcgatgttttaacctttcccggaaccccgtatgccattgagttttgtcgcaagtttgaacaatggctatttaaagaattcgatggctcgtatgctttagcccgtgttgaatggagtaaaggctgggcctatagcccaaatgccgcgtgggaagataatgatacactgaccaaaacaatcccggcttcatttaatgatggcttgcctgctgataatcattgggcttcatccgttgcagcattgcaacaatatgatcctcatcatctattcagatcacccttattggaaaaattaatttctggttaattattacgtcaataaatagtagatataaaatcatatctgctatttattaaatccaaaaaacattaattattatctgcttattatctgcttattatctgcttattatctgcttattatctgcttattatctgcttattatctgcttattatccgcttattatccgcttattatccgcttattatccgcttattatccgcttattatccgcttattatccgcttatcatccgcttatcatccgcttatcatccgcttatcatccgcttatcatccgcttatcatccgcttatcatccgcttatcatccgcttatcatccgcttattatacgcttattatacgcttattatacgcttattatccgcttattatccgcttattatccgcttattatccgcttattatccgcttattatccgcttattatccgcttattatccgcttattatccgcttattatccgcttattatccgcttattatccgcttattatccgcttattatccgcttattatccgcttattatccgcttattatccgcttattatcataaaattaaaacaccagcaatagatatatcaacaagtaatactttgaatatatttctaaataaaaccttattattattttatattatattatattatttaaagaaatatatattcaataaaacccattaatacttatttggatcgccatcctgataaaattactaacaaagtcaacgaatagcaaaatagagaaagatctgaatatcacactattacccatatcattgatggaaaaaaacgaacccataattccatcgaaaataaaaaactcagattcgcacagaagccctgcgctaacgagataagcatggtgaataatgcacaataaaaatacgaaccattgaaattccttgatacactacaacctatctcagttgcaattatttattaattttgaggaatcctatgtctttgtatcaagataatcaggcattcgcccaacttactctgggtaaagccacaccctactgtgatcactacgatcctactttactgcaagcggttccgcgcagcatgaaccgtgaaccacttgggctatttcctgataatcttccgtttcacggcgctgatatctggacaatgtacgaactttcctggctcaattcacgcggtgttcctcaagttgccatcggccatgtcagcctaagtgcagccagtgtgaatctcgttgaatcaaaaagttttaagctttacctgaatagtttcaatcaaacccgctttgcagattgggataccgtgcaaaaaacgctgcaacaggatttatccgtctgcgcaaacggtgatgtacatgttgttttacgtcccctgcacgatttcagccagcaaccgatcgccgagtttgaaggaaaatgtatcgataatcaggacattgaaattgatgattatcaattcagtcgcgattatcttaacgatgctgcagcaggttcggtcgttgatgaaatattggtcagccatttgctaaaatcaaattgcctgatcacacatcagcccgattggggttccgtacagatccgctataaaggccccaaaatcgatcaggaaaaattattgcgctatctggtttctttccgccatcacaatgaatttcatgaacagtgtgttgagcgtattttcaatgacttaattgcgttatgcgcacctgaaaaactcacggtttatgctcgctatacccgccggggagggttagatatcaacccgtggcgcagtaacgaagcctttattccagaaacaggaagactggctcgccagtaaattgagaaaaccccaccaagggcataaaggagtcgttcttgattacacatgtcagcccgttaggatcaatggatttactctctcaacttgaagtcgatgcactcaagcgtaccgcaagcagtgatttataccgcctgttccgcaactgctcactggcggtactcaactccggcagccagacagataacagcaaagagttgctgtcaaaacatgaagattttgatattaacgtcctgcgtagagagcgtggcgtcaaactggaactcgtcaatccaccagaagacgctttcgttgacggcaaaatcattcgctctctgcaagccaacctgttcgcggttctgcgggatattctgtttgttcatgcgcagattgacagtgcacagaaagtgcaccatctgaatatggaaaatggtatgcacattaccaacaccattttttctattctgcgcaatgccaaagcgcttcatctctcagaagatccgaatatgatcgtctgttggggcggtcactcgattaatgaaaaagagtatctgtatgggcgcaaagtgggtaacgagttggggctgcgcgaactgaatatctgcacgggctgtgggccgggcgcaatggaagcgcccatgaaaggtgctgcggttgggcatgcccagcaacgttaccaaaaaagccgctttatcggcattacagagccttccattattgctgcagaaccccccaatccgctggtcaatgaactgatcatcatgccggatatcgaaaaacggctggaggcatttgtccgcatagctcacggcattattatcttcccgggcggggtgggaacagcagaagagctgctctatctactgggtattttgatgaaccctgataataaagatcaagtgctgccattgatcttgaccgggccaaaagagagtgccgattacttccatgtgctcgataagtttatcgtcaataccttgggagaacaggctcgtcagtactatcgcatcattatagatgatccttcagaagtcgcccgagtgatgaaaaaaaccatgccgcaggttaaagaacatcgccgctctaccggagatgcctatagctttaactggtcactgaaaatcagccatgatttgcagcatccgttcgagccattccatagcaatatggctaacctgaatttgcatccgaatcagcctcccgaaaaactggcttctgctctgcgatgtgccttttccggcattgtggcgggcaatgtgaaagaagcgggcattcatgccattgaaaaagacggagcgttcaaaatccacggtgatgtggatatcatgcgccatatggatgaactattgaaagattttgtcaggcaggatcgcatgaaattgccgggaggtacggcttacgagccgtgctataaaatcatcaaataagtcacgtcctcattaaaatccaatgaggctgaagccaaggaatcaatccacggacggagcataacgaccatgatacatcttttgattgtagacgcactgaacttgatccgacgcatccatgctgtgcagggaagcccttgtgttcccgcctgtgagcatgcgttaaagcagctaatcacccattcttctccgactcatgccgttgcggtattcgatgaagatgaccgtggtcatagctggcgccaccagcttcttcccgattacaaagccgggcgttctgccatgcccgacgatttacagcaggaaatgccgctgattaaacaggcattcaatgcactaggggtaacttgctggcatgccgaagggcatgaagccgatgatttggcggcaacactggcaaccaaagttgtttctacggggcatcgagtcaccattgtttcaacggataagggctactgccagctactttcaccgaatatccagatccgcgattacttccaaaaacgctggctggatttaccctttgttgagcgggagtttggtgtttcccctgcccagctccccgattattggggtctggcaggggtcagtagcagtaaaatccccggtgttcagggaatagggccaaaaacagcggccattctgctacaacaaactggctcgctggataaccttttccaacatctggaagcccagccggataaatggcgcaataaattggcagcccataaagaaatggcgtatatcagccgtgaagtggcttcactgcgcacggatttatcgctcaatggcaatttgcagcaattgcggttagatcacaggtaagtgaccgttgtactttgcactatcttatttgaagtcaaaatactgccgaaattgagtatttacggtagtattttgttatttaaatttatttaatggtaaaatttaatcactcaaaataccccgaagctaattgaatatcctccccattcaattgcccagattcactcaataacccaatccaggatttcatatattggtacttggcctgagaaagatcacgacgagccatgtagagctgttgctctgcattcaggatatctacgttaacccgctgcccaagtgccacgcttttctgagtcgctttaacctgtaattcagccgcttccactgccgattcataggcacgtatccgcttctcgccattcatgcaggcgttataattgcgtcgcagcgcattcagaatttctcccgcttcagcatccatctcatatttggctctgccataattcgctgctgattgacgcactgccgccgacgttcctccaccattatagagattcatcgatacccgcaagccgattgaatcggtgcggtatttttgatcgatgatgttatcgctgctggatttattttcagtatgggaagcatacagctccagttttggcagataacctgcccgattgcgctcaatgtcctgagccgcaacggccactttctggcgagcctccgccaactgcgggttttgactcaacgccatctgctcccaatcggcataatgtgcaaaagccagctttatagtcttgaagttctggacaggcgacaggcgattgaccggtaagtcgcttggtaaaggtgtaccaaccagcaattgcaagtcacggatcaccgcatccagttcatctttgaccgttaactcatccgccacaatctgactgtaacgggcttgggtttccgccacatcagtgcgcgtgccttcaccggaggcaaacaatttctgattccgttccagttgttcttcataagccctgccctgctgagcaacctgcgccagcctgtcctgcgcataagcgacatccacatagctgtttactaccctgactgccagttgctgggtgtctacccgaaaacgggcatcactcatcagcgcgtaggcctgacgggttttgtaacgcgcccacgcctcgaaatccaccagcggctgagtcagcacaagcgaaccactgtagctgtgatactggcggttgcgactttccgtgaccgtacttcccctttgccctgaatctgaagaagaggattccattttctgccaattctggggaacatattggtagttaaaagcgagcttgggcagtaattccgcccgcccaaggtttttctcttcctgccccgcttcctgcgcttttatcgccgcctgaaacgtcggatcatgttgcagcgccagcgcgtaagcttccgttaaggaaagcgcctgaaccgtacctgaaaacgacatcagcagaaacagagataaaaacaggacacgccccgtaaaaccactagatctgaacatccccgttactcctcaatcagtgacgttgacgccctgtccatcaatggcttgaatagataactcaacagtgagcgcgaccctgttttaacgaagacttcaaccggcatgcccggcttgatatgtagccctgccagttgtgccattccctctggcgtcactctaacccgcatctggtaataaggttcccttgtcaccccatccaccagccggtcggcggagatcactgtcactttgcctgtcactttcggcgtctggttctgattgaacgcggtgaacatcaaatccacatcctgccccatttctactttatcaatcagatgtaccatcaagcgcgcttcgacttctaacgcactctgggcaggcaagatttccatcagtttttccccggaagccacaacaccgccttgagtaaatactgtcagccccaccactgagccacccaccggggcggtaattgaggtatgggataaatcaaactgagctgtttccagcttgtttttcagctcattggcctgcacctgcacatccgaaagctggctgcggacttcacgttgataatcagcctgccgctggataatccgctgccgggtttcctgacactgtttttcaagctgaccaatgcgtcctgccatctcggccatgctgccacttaactcactttgactgcgctgcaactccagataacggttacggggaaagtaaccctcttcggtcaacggccgcagattggtcacttgctctttgagtgaaacctgctgctgctgtttattcgtcagcgcttcccgcaaccctttgagctgaaaactcagcccctcttcagcctgctgcatcccagccagatcacttctcagcatctcacgacgtgacaggaaaagctgtttctgcaataccagaatatccttaatacgtggctccgattgctgatccgacaacgtagccggaaaggaaatcacctccagcccttgctgctcggccagcaatcggacttccgtcgccagagtggtatgcaattgctgtttcagggagtcaatttgggcattaacctgcacctgactaagctgcaccagtacctgtccggccttaacctgttccccttccgatgccagaatttgtctgatgatgccattggctggcgactgcacggttttacggttgccatccaccaccacaataccgggggaagcgacacctttatcgagcggggcaaaagccgcccagacgaaaaaccccaggaggccaataccgatgaccagccagcccagccgcaggtagtgatttgcatccagcggcagtaatcccgattcatcatttttcgcactttttgcgttggtctgataggacatcttcactcccaggcagaaatttcactctgcccactgattaaaaccgtgtcattaaaaacatggcagagccacactacgaggcacgttcaaccgcttttgactgcgacagcgccgccataacttgctgagatgggccaaacattttcatttttccctgcaccaacagcaaaattttgtttgtttgtgagagcaaagaaggccgatgcgtgatcaccaccacagttttgccctgttcccgcaattgcgtaatcgcctgactcagcgccttttcaccaatatcatccagattggaattcggttcatccagcaccagcagtgacggattgccgtacaatgcccgtgccagcccaatccgctgcttttgcccaccggacagtcccatccccccagcgccaatcaccgtgtcataaccctgttcaagattgagtaccagttcatggacgcccgcttttttggccgcttcaatgactttttcaggatcaacgtcattaaaacgtgcaatgttttccgcaatcgtgccaccaaacagttcgatgtcctgcggcaaataacctatcgatgctcccagttcatccttgttccattggtaaatgtcggcatcatcgagccggacaacaccctcctgtgacggccaaatccccaccagcaggcgagccagcgtagatttccccgacgcgctggggccaatcacgcccaacacatcgccggcattcagggaaaaactgatatcctgcaagacctgtttatgatttcccgccgtttgtctggcctgtgttttactcggtggtatcgcggcaactttttccagcaacaaaatgcctttaggggcaggcagtgacataccgcttttgcgttctggctgcgccttcagcaatttatccagccgctgccatgacagacgcgcagcgctccagcttttccacgcttggatcaactgctcaatcggcgacaatgcccgtcccatcaagatagaacccgcgatcatcatgcccggcgtgatattgccttcaatcgccagccagcctcccaaaccgaggatcaacgactgcaaggccatgcgcactgttttggtcagtgcggtgatagatgccgcccgttcgctggcaatacgctggaaattgagaaagcgctcatgcaggctaaaccaacgctgacgcagtgccggcaacatacccaaggcttcaatgacttccgcattacgcagattagtactggcaagattagcagagcgcagggagagatgacttgcttccgataaaggcgactgagacagccattggttcaataccgccaacgcgatcaaaatgatcgccccaaccagcgccagcaatcccaagtacgggctaaacagaaaaatgacccagagatagaccgggaaccaaggcacatcaaaaaaagcaaacagcgcattgcccgtcaggaactggcggatagtagccaagtcattgagcatctgcccggcatcggtggagccatttttcaggttggactcatacgacgcggtataaacacgctggttcaggcacatatcaaactggctaccgatgcggatcaccaccatgctacggatatattccagcccccccataatagcgaacatgccgagcgtgatcagggtcagcatcagcagggtcatttcattactggagggcagaactcgatcatatacctgaagcatataaatagagggaaccaacatcagcagattgataaatgccgtaaataagccaatagtccagaatactttgctgcgtgcacggataacatccgtgatttcatcctttggaaagcgtagtttcactgcaatcccttcatcattaactgaagcaaaaacgatttatttacccagtaattcgttatttttgttttattttgtcactgcatttactttgtcactgaatgcgtgccactgaatgtcataatgagttcccgcccatcaacaaggtatgccacccattgctcggactcatgaccaaaaaaggccagactattgccatcatcgtcagtcaaagtgataccatcaggtgtaggacgccagccctctacagggttcctcatcagttcggtcaggcaagaatcacctttcagcgcccaaatggacccctcaggcaaacgggtatccgttaattcaatactgcatacctgatttccatctgatagctgccataaccctttcagttcagccggctcaggaagtctcaaactactcgccatacatcctccaatcaaaaaaagagaaaacattatcgataaggccaatttaaataaacaagacttcgttatacccctttgccccttgtgtaacacagcgacttcctcctcgtaatactgccgtaccattaatacctacggcagtatcgcgctatcgtgacatgccagtctgcattagacgataaaatcagcttcagctacaggctgaccgataattttcaccagaaaatcattactgactaaatcaccaccaaggctgatcgacatatcggttatatcggtcactttgtcgtaagtcagcaggacttcacccgccctaccagagaatgaatcaacaaatttgatatcacccttactaccaaagttaaagtccgatagatcaatcttgtcttcaccggaaacaaaatcatggatccagtcaggattgtctttcagtgattctttgccattcagataaacaaaagtatccttgcctgcgccaccccacaggtgatcgccgcccaagccaccataaatgatgtcatcgccgtcgccgcctttcagcacgttatcagcactgttgcctaccagaatgtcatcgccgctgccaccgatcgcattctcaatggttacaccacgggcaatagatacgttgcctttcaaaccgccaacatccgagaaagatcctgcattcaggttaatacgctgatcctgagtaaaatcggaaaaatcgaacgtatcattaccatccgcatcccagacactgaataccagtttgctattggcatcggttgcggtcatgaaatcacggtcggtattggagttgaaaccatataccgtatcacctgtacgagtttcagtattggccccatataagtcttgaatggcggagatatcattcagcaatggcgcagatgagaatgcccctttgtaatcctgaccggtgtatttttcactgaaatagctcatgacggtataggcacggctatcttcgaagtattcacctacactgatataggtcggtctgaccgcatcagaagcatcgtactcggcaggatgatccagacccagcgtatgcccgatttcatgggtaaatgtctggcggccatagccattcacgccaatgtcattgtctatgaaagtatgactctccgcgctataccaggaataagtcgtattctgcccttttggtaaagtcgcaaacgcatagtcgtcagttatactataatcaaagaaaccaaaagtaatattggctttagaaagactgctgacttcattaaattttacattggcaacatcagaccacgattgcaaagacaatcttgctgcctctttctgctcatcattaaaggaactgaatccggcaatgccaaatcttggcatcacggaaggagcagattctagaaaatgatatgataattccactgcaccggaagagccgactttattcgaccaatgataattggttcgcacaagttcatcgggagctttatctcccagcggtgtatgtgcgacacgaatacccggatcggaatttggaacgtaggctgtgagaagtgcattaacatcctgaacggacttggaatcagataaccccacataggtatatttattctttgaggtcatataaatctcctgtaaaaacaatatttatatctaaagcccgaaattttcataataacgggagtaagagttttttattctttctaagattcccttagaaacaaaactctcgaataaaatagcgtgagttttattccgtgtaaaaataattaatatatctttttagaatacaaataaattaaatttaatttacggaagaaattattaattttaaaattaatttttttgataacaaaaaaacagtattattttttaataaataatactgtttttatctgctggaaattgatcctaagaaaggattatctatttcgcaataattaaaaatctcgggtcattgcatatgcagaccaaatacgacgaacatgtaccgtgacctcttcacgatcgtggtacaagtgcttggcctgaatttggacgttaattccattttctttcaattgctgttctatcttctgcaagatctgagcaacttcctcataacgctttttcatcggcagcttgaggttgaaaatggcttcacggcaccagctttttactaaccagtctgtcataagctgtgcaaccttggccggctgctcaaccatgtcacaaaccagccagtaaacatttttcactgagggttcaaacttaaagccatccacacgatgatgtttcacctgtccggtgtccatcaaactatcagccatcaagccattatctaccgcatgaactatcatgccccgtctcacgagctggtaagtccagcctcccggacaagcaccaagatccacagcatacagcccactgcccagacgttcttcccactcgtcatggggaataaacacatgaaaagcttcttccagtttcagcgttgaacgactcggagcatctgacggaaacttcagacgagggatccccatataaaaacgggaattgttgttgctgtaagagtagccgacgtaacaacagcccggagcaataaacaaaacatgaatcaccggtcggtgagcactttcctttgccagcaagagtttttcctgacgcattgcattacgcaacggaaccgtaaacttacggcagaatgtcatcaactctttactttcatcattatccggcacttctacgcgcagctcgcctgcacgctcaataaccccagtcagcatcccaaggatcggggtaatacgatcttcctgaggtaaatttttcagcaattcacccacaaccaccatttggcgggcaaagatcaattcaccgaacggaatttcacggatcagacgatccgcatcatcatgctgataacactcaaacaacacataaccgctgttttcttttacgcgggcaaaaccgtaaactcctttcttacccgccttatcagtaatttctgccgcacactctttttcaaacccggggcggcaatataaagcaactttattcatggctaggcgccaatttccttagacgcagagcgccaattaatatacataaccaaccaatgagaaaactgaacccaccgattggtgtcagataaaccaaaaattttagcggtaaaaaggccagacaataaagactgccactaaacaacaccattcccgcagcgaaaaaaatacccgcccagccaaacggcttcattggctgccgcatcagcaaaacagccagcaccatcatgaccagtgtatgcagcccctgatattgcaggccggtatggatccattccatttggcgtgacgtcaggacaggtaccagcatatgtgcacccatcgcacccaatgccacatagaaaaaaccgctgatacccacaaaaataagcatgacacgactgctcatcgctccgctcctgtttctggatgtatgaaatgacactccttcacacatccggttttcattcgttagtaataaaccctaaccttgcctgttcactcgcggcctgcatcaagatccatttccgaaaagccgcaatcttgcccaattctgcctgattatcatggcaaaccaaataaaatgcattcttgctgaccaaaacatcattgaatgggcagacaaggcgccctgcatcaatctcattttgtgccatcacattattggcaagagcgaccccctgcccatgtaccgccgcctgaatcaccatggagctatggctgaatatcggcccctgctgaacattgatgagctgttgcatatcaagctggcgaatataggcctgccagtcccgtcgggaagaatcgtgcaacagagtatgcttggccagatctgccggcgtttttaatggacgttcacccatcagtaaagagggagaacagacgggtagcagatattcaggatagagacgatctgttcgcatgcctggccaattgcctctgccataaaaaatcgcaacatcaacatcatctgccaatttatcttcttccctatccaccgcctgaatcctgacatcaatgcccgggaaactctggttgaaaccagaaagccgtggcaccagccactgaatggcaaagctcggtgacaaacttaccgtcagtgcacctttggcactgcgagcctgaagtttgcgggttgcatcattgatagcagtgaaaatttctttgatatccagatagtaactctgcccgtcctccgtcagcagtagcgagcggttacggcgacgaaaaagtttcaatcccagaaagtcttccagacttttcatctggtgacttacggccgcctgagttacaaataattcttctgctgctttagtaaaactaagatgacgagcagcagcatcaaaaacgcgtaacgcattaagtggtggtaaacgtttagacatgttcgtttcttatatgatagtggcgataccgataattctcttctctcaagtattagtttttgtaatccgaatcattataatttgtccattgatgatataccagcaaatccctatagtgtgcgcaacttcctaagccggaacgaaaagtaactctgtagtgatacattgaagcttttggctttgtggttgtgatgttgtgtttgcaagttgtctggtctaccagactttgtagcatatgctactgttttttttcacttcctgtacatttaccctgtctgtccatagtgatttttttaatgcaccgcaattgcggtgctttttttctcgactttcctgtagaattcccctccacttggttaaagaaaaacttattctttacgacacaacgttgaaattaacaccgtttatgaaatcctttgactcagaaaaatttcgccagcaatttcctgccctgcaacagcagactgtgtttttggatagcgcggctacagccctaaagcctatatgcatgattgaggcaacccagcactattatcaaaaccacagtgcaacggttcatcgtagccaacacgcaagcgcacaggccatgacggcccgttatgaacaagctcgttcgctggtggcggaattgctcaacgccccacggcctgaaaatatcatctggacaaaaggcaccagcgaagccattaatctgaccgcccaaggctattttcgccctcgcctgaatgtggatgatgaaattatagtcagtgaacaggaacaccactccaatctgttgccgtggctgattctggcggaacaaacaggcgcaaaaatcgttaagtggccgataggcaatcagaatcgtccggacatcaatattctcgcaaaactgctaaatgaaaaaagccggctggtcgccatcagccaaatgtcgaatgtcactggtaccacagtcgatctggcgcaggtcacggcactcgcccaccagtatgattgcctgattttggtcgatggcgctcaaggcatcgttcacactcccgttgatgtacagcggctggatatcgatttttatgccttctctgcccataaactgtatggccccaatggtctgggagtattgtatggcaaaggggaattgctggatgcaatgtcaccgtggcagggcggtgggaaaatgctgactcaggtatctttcaacggtttcacaccagaagccgttccttatcgctttgaagcgggaaccccgaatgtcgcgggcgtggttagctttgccgctacgttggaatggttaaaaaccgttgatatcccgctcgctgaatcccatgccgttaccctgactgactatgccgagcagcagctcagtatctttgctggatttatcagctaccgcgccgccaatgccagtttgctggccttcaatatccaagggatacatcacaatgatttggcaacgttgattgctgaacagaatatttccctgcgttcaggccaacactgcgcacagcccctgttggatgctctggggatcagcggctgcctacgtgcttcttttatgccttataataatcggcaggatgtggataagctggtcagtgctgtgaaatttgccctatcgctactggaagaataagctaggcaaataaaatatccaccaaataccattgcaagataaataaccgatgacatcaatttcagattcaatccttgccccgcatccgtttggaacggagatatcggagcaacaacttattgaaaattttcagcaatgccagttatgggaagatcgctatcggcagcttatcggactggccaaaaaactgccaccactagcggatgaactgaaacagcagaacattgaaatgtccggctgtgaaaaccgtgtctggctagggcaccagttgcgttctgacggctgtttgcatttttatggagatagcgaaggccgcatcgtcaaaggcttattagccgtactcctgactgctgtggaaggaaaaacagcagagcaggttttacaggcgcctttatctgagttatttcagcacatgggtcttgagcaacaactgagcggttcgcgactcaatgggatcaaatccctgatcaacaccgttcaagagattgcccgctcacatttgtcttaaattcttacctgaacctaagctttaaagcctgttttcccgctcggcttttgccaccatctttttcagtgcgtgagacacggcaataaacccaaatgttgccgtgaccatcgttgcggcaccaaaaccggacgcacaatccatccgtttcgaaccatccgccgtgcttttggcagcgcagaccgtaccgtcagattgcgggtaaaccaactgttccgttgagaatacacaatcaatccccaatttacccttgctgtttttcaccacgcgatagtcagatttcaggcgttccttcaatttagccgccagcggatcttgcaccgttttcgccagatccaccacctggatctgagcaggatcaagctgccccccagccccgccagtcgtaacaagcggaattttatagcggcgacaataagccagcaatgccgcttttggacgcacactgtcaatggcatcaatcacataactgaattcagcagacatcagctcagccacattatcgggcgtcacaaaatcatcaacgcaggtaacttggcactccggattgattgcccgtatccgttcagcaatcacctcggtttttggcaaccctacattctgtaccagcgtatgcaactggcggttagtattggtgatacagacatcatccatatcaatcagcgtgattgccccaatgcctgtgcgcgccaatgcttccgccgcccatgagccaacaccgccaataccaacgacacagacatgtgaacgggcaaataatgaaagtgctttctggccatataaccgcgcggtaccagcaaaacgctgaagataagcatcagagagagaaacttgcatcactaaataaatcctgaatcagagcctatctcggtaggcgtaattaatgggatcggctctaagacctaccccatagagataatttatcgattgttttaactgggctggatcttactggtttgccgtcaaaaagccaggcgacgatttcttcaatacccagacacggccatagtgattataaaaaccggctgcttctccagcatcatgacccacaccatgatagatatcgaaatgattgccttttattgcgcctccaacatccaatgccaccatcaaacgcatccgatactgtccggtaaattttcctgttttatccaacaccggcacttccgccaataacgccgttccgagtggaatcaataccttatccgatgctacggatgcttccgcgacaagaggcacagcactggctccccgcacaggtgtaaagggttcgggcttaaagaaaataaaagagggattctgttccagcagctctcgtacctctgattcattatgttgagatgcccactggcgaatggctttcagtgacattttttcaagaggcacttctcctcggttaacaagtatcttgccgatactctgataagcatggccattcttcccgctataaccgaagaaggtcaatggattgccatcaccaaaatcgatataaccactcccctgcacttccatcaaaaaattatcaatcagggaattagtgtaccctatgataaatttttcactcaaagccccattgtatatagctgcacggtttggcaggcgaaaacgcgacttacctggcattcggtacaggggatatttaaactcgccctgcttaacatggcgtgcctgcaaaactggcgtgtaataaccagtaaacttaacattaccgtaattatcatcaccgtccatctgataggccagcaacccaaactggtttaattcacgcggatctccaccagacagcatccaattctggatggcatcaagcgttgcacgattattaccatagagccgaggagaagatttgctgataaatttgacttgtgcctgaaaatctccggcgttgataggggagccttgtgcatttggaatattaacaagctggagatcttcgctgatgcggccatctttatactgctgcccttgatctgtaggacgcacctggcaacccgataataacgaaatgacaaacccgcataaaagatatttgccccaaagtttcatattatgccttatctcctgtcatcacgattcgacgacgaacaatatcaaaccccggtaaataataaaatgtcgttaagaaaaaatagattaccgttccataaacccataaatgaacaaaaaatacaacaaatagtgctatttttaaccatgcaataaataaaatcggtaaatatcaacaaaaaacttgcaacagcgctgaacctgcgtatagtgtgccgacatcagacgcggggtggagcagcctggtagctcgtcgggctcataacccgaaggtcgtcggttcaaatccggcccccgcaaccaatcctatacgatgtcatatcggcagggtttagtaccaaagaatgttatcatttagtatgtgcaagtagtagacggacgcggggtggagcagcctggtagctcgtcgggctcataacccgaaggtcgtcggttcaaatccggcccccgcaaccaattctgtacgatgtcatatcggcagggtttagtaccaaagaatgttatcatttagtatgtgcaagtagtagacggacgcggggtggagcagcctggtagctcgtcgggctcataacccgaaggtcgtcggttcaaatccggcccccgcaaccaacttttcttttgtatttttcacaatctcacttccttgtattttccaattttccctttgtttttttaattctgtttgttttattcgcactgattaaaggcggatatttcaccgccgtgccagctctacaccacttttaaaataagccttaatacctgcaaaaatggattccgctacttgctgctggaatttcgccgttttcaatttgcgttcttcttccagattactgataaatgccgtttcaaccagaatggacggaatatccggtgctttcaatactgcaaatcccgcctgatcgatactatttttatgcagtttattgaccttgccaatccgtttgagcacttcactgccaaacttgaggctatcattaatcgtcgcggtttgaaccagatccaacatagtatgatccagatattcatcaccacttttgctaactcccccaatcaagtcagcctcattctgggtctgtgccagaaaacgagcggtattgctggttgctcccttagttgataacgcgaacacggaagatcctcgggcggttcgattggtaaaggcatccgcatgaatggagacaaataaatccgcctgcatcttgcgtgctttcgcgaccctgacctgcaatggaatgaaaacatcctcattacgcgtcatgtatactttcatgccgggttcacgtttgataagtgtttgcaggcgacgggcaatctgtaacaccacatctttctcacgggtcttgtatttcccgatggcacctgaatcttcaccgccatgccccggatcaagcataataacaatcggtctgttcctgcccggccgccccggttttctcttttcagcaggtagattcttcttcaaatccccgctgttgtattcttccaacagcgcttgcaagggatcatcctccacatttgccgccttactcggataaagatctaacaccagacgatgtttgaatttcgcaatgggtggtagtgtaaaaatatgcggggcaactggctgcttaatttcaaacaccaggcgcacggttttgggatcaaattgcccggctcgtaccaattttaaatagggatctcgctgatgaatctgcgaccccataccgctcaggacactattaagctgaacaccctgcaagtcgatgacaatccggttagggtttgaaagagaaaattgacgatatttaagtggaatattagcctccagtgtcactctggtataacttgatgcaggccagatacgaacagcaataatttttgacgttgctgcgtgtcctattgagctaatgctcaacaaccacatggctgctgcgcctttcaacaaattgcgacgtgaagaattatagtctgaatgactcatcgtttattccatttaaaaacaaccaaacgcggtaatcttgccaaaaaagactgtcaggcggcaaactctaattaattagcgagtggctgtcatcaaaaaaagcgttttatgctctctcaatttattaatatcaatataaataatatcgtaatttttatccatgttccctcttgccatttttgacaaaaaagaataaaaatacaaaaattgtgaataaaaattcattaggaggtttcatgaaagaacgctgtaccgaattggttgaagttttccggcattcagttccgtatataaatgcacatcgaggcaaaacctttgtcattatgttgggtggtgaggctatcgcccacgagaattttccaaatatcgttaatgacatcggcctactgcataatctgggcatccgtttgatcgtcgtgtatggcgctcgtccccaaatcgaccagaagcttgccgaataccatagccagccgatttatcacaagcacaccagagttacggatgccaagacactggaactggtcaaacagtccgcaggcctgctacagcttgatattacggcccgtctttccatgagcctcagcaatacacccttgcaaggtgccaatattaacgttgtcagcggtaactttattatcgcccagccactaggtgtcgatgatggcattgattactgtcatagtggcagggttcgccgtattgacgaggaggccattaaccagcagctggataactattccattgtattaattgggcccgttgccgtttccgtcacaggtgaaagtttcaacctgacttccgaagaaatagcctcacaattagcgattaaattaaaagccgaaaaattgatcgggttctgctcatcacagggcgtacttgatgcagaggggaatatcctgtcggaaattgttcccaatgaggggcaagcacgactgaatgagctggaaagtgagggggattattcttcaggtaccgtccgcttcttgagaggagccatcaaagcctgccgtcgtggggttcgtcgcagccatttgatcagctatcgggaaaatggctcgctggttcaggaattattctcccgtgaaggcagtggaacccagatagtcatggagcgctccgaacagatccgtcgagccaatatcaatgatattggtggcattcttgagcttattcgtccattggaacagacaggcatcttggctcgccgctcacgggaacaactggaaatggaaattgataagttcactctgatagagcacgataatgtaacgatcgcctgcgctgcgctctattcttaccctgacgaaaaaattggtgaaatggcctgtgttgcggttcatccaaactaccgaaactcttcccgtggcgaagtgttgctgaattccatcgccggtcaggccagacaggcagggctggagaaactattcgtactcacgacccgcagtatccactggtttcgggaaaaaggctttgaacctgctgaaatcaatatgcttcctgtggaaaaacaagcgctgtataactaccagcgctgttcgaaaatcttgatgttaaatttagagattcactgacctgactggcactttccctgtggcttgagccattctgccaagccactacgccgctgtgttgatgtacccaccgccttatccaagacgggtttatgtgcgtaaagcgtcaatttttcacgggcacgggttaaggctgtgtacaccagttcccggctgacaactggcgagaactgagtcggcaagactaacgcggtgtgttcaaactcagaaccttgggatttatggacagtcatcacataggccgtttcatgctgaggcaatcggctcggctgaaatggctttatcgtcccatcagatagctggaaatgggctttcagctcattatccttattcctgagcataataccgatgtcaccattaaatagccccagtgtactgtcgttacgcaagatcataatgggtcgtccagcatagccacggctctctgcatttctgggtagagaaatgacgcctttacggtgtaacaattgctctacccgctggttcaagccgctgacaccaaacggcccttccctcaaagcacacaacaacctgaaacggttaaattctgccaaaatatctttgtcagccgcctgttcgttcaccatcgctaaataacggtagtaaccttctgcagtttgcgtcagtaaacgctgataatcttcatctcctgaaagaggattgaagtgaacatcaggcaaagaccgacttaatacggcagataccccgacactattcccctgattaaccgccgatgccaattgcccgatacccgaagccgagttgaaacgatagcttttacgcaacagacataaacaatcacggactgccagtgcatgttctccagaatcaggcattgaatacgatgttaactgacagcctgtcaactgactcaattgttcagcacgcttggtgctataaccttgttcagaaaagcggcaaatatcccccaatacggctcccgcttcaaccgaggccaactgatctttatcccccaggaaaatcacttttgcccgtggcggcagggcttctatcaaacgtgccatcatcggtaagtccaccatcgaggcttcatcgatgatcaaaatatcaagagatagcggattatcgcggtgataacgcagtttttgactatctggctgcgctcccaacaggcgatgaatcgtttgcgcctgctcaggaatgctattcgattgttgtgatgttaaagccagtttatctactgcctcactcagcgattcagtcaatctggcggccgctttgccagtgggcgccgccaattgaatgctcagtgttttgccttcattcagtttgatcaaggcggccagcaacttagctaccgtcgtcgtttttcctgtccctggcccgccagagatcacggaaatacggctggttacagcaactgctgccgccactttctgccagtctatttccccttcggcggtcacaccaaaaagttcatccaaaatgcgacgtaactgcacttcatcaatatcgtcagaaaattctaccgacgaaaaaaactccgcgatccgacgctcactttgccacatgcgttgcatgtaaaggcgataatcagcaagtgcgtggcgggaaagaatgatcggtgtgggagattcgccagtgctcactgcggaacatgcttgtaaagctgaaataacttgctgctgatttggtttccccgccgaagaccagagcgatgctgccaattcaggctgccgcccctcaaataaatattcaggcgagatccgctctaatggcaggcagacatgccctgctcccgattccgcactcaccaatgccataaccagcaataacagaggatctccgttttcaatcatcgcataggcaaactgcacatccagcggacgcagtaatttttgggcaacggcttgctgcaacaataatttcatgtcactcatacaccttgctcctcgccagcagcgctgaaaagcctatctagttcgtcaacaaattcaatggggggcaaataacgataaacaccatgtcctggattagccttatcaatcccacgcagaaacaggtagatagctcccccaaaatgctgctgataatcataattcgccaatcggtgacgcaaataacgatgtaacgccaacgtataaagttgatactgcaaatcgtaccgatgttctatcatggctctggtcatggcttcctgagtatatgactgactgctctcccccagccagtttgacttgtaatccaccacataaaacttaccctgccagcaaaaaactaaatcaataaaccctttcaacatgcccctgacctgatgaaaggataaaggtgtacattgtgcagacagcggatcataacggcgggtcaatgcactcaatgcatgtgaatgcagcagcttatcgacaggtaaataaaactgcatttcactttgttgctgatgacgaggaacatgggcaagttgcattccctgctcattcaactctgcggtcacgaaatccgctatccactgctgcaatactggcgcccagttctcatcaaacccggctgccgttaatttttctgccagccacatctgctcaggtagctcgctgaaatcaagatcttccaagatgctatgcaagaaggtgccagcagatgccccgcgaggaaaagtatgtggtgtcatctgcgatgacggttcctcctgcttttcaccacgcgcatcaatatccagtttcggggcaatcgactgcacaataacatccaccgattctccaaacgcgctggcatacgcatgggaaatagagtgcgaagaggaatactgcaagccagaataactggttacccgccaatcatcctgaatggagcgccggaattttctggccgccagcaatgagtcattgtcattttgcgaacaccactgcgcatcatcagtttcctccatcagcgtgacctgaatatcgccattactgagttcatctaaactatctgccagcaattgcgcatcaccttgctgccctttctgcaacagataaccaagggcagataagtgtaaatccgtattgcctgcttttttcttattaccttgaataagtggcgcaaccccgacactacagtgataaatcgaccgtgttaaggcaacatagagcagacgcaaatcttctgccaatcgctcttcatctgccagtgccttcttttcatcatcctgaaagatactgaagtgagtctcaaaactctgacgatcatggtaaatcgcctgttcctgtttcctgaaactacatatgaacggcagccaaaccagtgggtattccaatcctttcgatttatggatggtacatatctgcaccagatgcttatcactttccagccgcatctgctgggtttctgattggggatcaggacgggaaatctgttgcgccagccagcgaaccactgcatgttcgctatccaattgcagtgatgtttcctgcaacaactcgccaatgtgcataacatcagtcagccggcgctcaccgtcatatccggccagtagattttctgcaatctggtatttcaccatgaccgcccgtagcatcggcaacaccccacggaagcgccataaccgggcataaccggaaaattcatccaccagctgatcccatgcggtttcatcgtgatttagctgatcaatttgctgcgcactcaggccaaacaagctactggccaatgcgctccggagttcacgctccttctccggtgatagcaccgcttgtaatagccaaagcaaatccttcgcttctggcgtatcaaatacactgtcacggttggaaagaaataccgacggtatcttgagcgcatttaattcatcgcggatcagtgccgcttcacgacggttacgcaccagcacggtaatatctgccgccgtgacgggttggcttttttctgcctgctgcaaaaatgcctgtcccagttgcccagccagcaaccaatcccggatttgagcagcacagtgccgcgccatgctttgttcatattgccctttggaaattccctctccgggctgtaaccaaaactgcaaagcagcctcttcctgattgtggaacaagaatctcagattatggtttttttccgcggctttcacattaataaacgggatttggctgaacaggaagggccgctctgtgtgggaaaacagcttattgacagcttgcaccattggcacagaagagcgccagttggtttccagcgtgtaatgggcactgacttgggaacgcgcccgaatataggtaaaaatatccgcaccacggaacgcataaatcgcttgcttgggatcaccgataaacagcaaaccattctcccgctgctcattttgcggctgatcgcgatatatggcttgaaaaatacggtattgctgcgggtcggtgtcctgaaattcatcgatcatggcaacgggataacgctgtcggatagtcgtcgcaagctgttctcctccctcccgttgcaaggcgctgtccagccgcgtcagtaagtcatcaaatcccatgtgtccgcgcatcaatttttcctgattgacggactgacgtatttcaacaattgccttggagataatgatgtcccgcagtgttagcggttgctgatataaatcgtcgatgacagtaaacacaggatgctgaggagcttcgccctttttggttttttccgccaatcgtgactgacaaaatttatctaaatctttgggaagctgataatcactagtctgcgatttagcccattcagaaacactgttcagccagttgggtaagtgctttttactgtaactacgtttatcaacatcagaattggcaataagatcgtgtaaatccgatgctacatcattccactgatgcttgactgtatcaatcagaccaatgatcttttcatgacggccaatcagagtttcatcactggcaggcgcattgacgatataaggcatatccccttgtagatgagaggaaacatccttaagcagtgcctctggcccactccactcttgattgatcaccgtcgccattgacaacgagagcggatagcagtgacgccgccaaaaatcggcacagccttgtttgcgcagcgggtattcatcctgaatcaacgtttggtcaaacagaacaccggattcaaaggcattgtgcaccagcattcgctggcaaaaaccatgaatagtataaattgccgcttcgtccatttgacgttcagcagccagaagccaactggcagcacttgctctgtcaggaatttgatccagcaattgctgataaacaggatcacttccctccgttccttcgcgaatacacgccaaacgaagctgatggatattttcacggatacgtccacgcaattcatccgttgcagcttcagtaaaggttacaacaaggatttcttcgacatttagcgggtggaaaaaggcggcatcgccgcctaatccgagtaacagacgaagatagagcaaacctatcgtgtaggtctttcccgtccccgctgaagcctcaatcagccgctgaccatgcagcggcagtgttaatgggttaagtttatggtttagtatttctgtgctcactgagcattcaccttaaccggcaactgtttctggaaatctgacacgttagagtaagttttccagcctgtcagctcagcatattgatgagctgtcccttttttcccagtaatttgggaaatcagtgccaatccttgacgcttcataaccgctttatcataaaaagcaatcagttgtgccttagtcactttctccgtagcggcaatggttttttcgtgtgtatcaaatttgaagttattactcccaaaatcataattataacgggatgcttctgcataaaaagtttctggtggctgccgcatttctgtcaataacgcttttttatactgtttaaaatcagcatcagacattgcctgtaatttttttgcggcctgttgataaaagctctggtaacgttgatgcaggtaatcgggttgcttgctgttactctgcaacaggaagcccaatcccgattgttcacccacgctagtgttgaaagctgaagcaacatagcccagttgttccgatgttctgagttgttcaaagaaccaaggtgacaaaatacgccccaacagattggaatagatataaccattgattcggtcatatcccgttggaatatagacttcagacagtgcattatcggtactgctggcagttcctttaaaattcaccgcataatcacgatcaaccacgatatggtcgccactccaccacgtagtaccctgatttgcgagttgcttgtgtgccgacttaacgatatcgatactctgtttttccgttaaattaccgaaaattcccgcctgtaaagccgaatgctgaatcattctctgacggtatttaacaatatcgtcaatcgtgatggtatccaaaactttcaaacggtcagcctgctcaaaataaggcacacgagaaagacgggagacggggtgtgtcgccatttcataagccttgccattattgacggctttcacttggtcacgataccgcgattttgcctgattcagctcttcctgagtgggtgtgaacgtaatgtactggctgatggccgaagttaatagttcaggcaagtgctgagtataaccactcactccaatttgcaggccttctgaataccctaatgttaatcccatgccacctacagatgcctgatagccaagctgatccaatcccatatcactcaaataggacaataacgaataagtaacctgatctttggcattactcattccatccgcattacgcatattcaatgtgatgatggacttgggttcatccataaaatattggctctgcatatagagcaaacgaacatttggctgttcaaaaatcattttcgggtgtttttgactgcctgatgccttaatcaaagataaatcatcaggaatatacgggttcagttctggcaaagagagcgaaacctctttttcgagtttccgccattccgtccgctgctgcggggtgattttattgacctggtatggcgcatgaacaaagtaagcttccttgttatgtggctcttccgggccggtaaaccaaatacgcgcattttcaggtgtcagttcagccagacggctggagatagcttgtgggttgtattcgtccgcaagatagccgacgtccagtacatgggaaacagggacatcctgcataacatcagacaaccactgaatgtagcccatatcccgcacgattgacgcatactcgaatgataaattgagtactttagccatttcatcaaaatagctcttttcaatgcccttttgctttaacagattaatgtaagagaagatggccgcaataacccgatcacgctgctcaaaccctttgtccgttaatgaaacatcaataccaaacgttcctgagttaccatccgttgtcgggctggcgctggcactgataccttcaaccaatccttgtttctgcaaccagtcagacagcgtgttcgcactacgattaccaatcagataccccagatatgtatctgttttgctgcgaaaatccgcactgttgtcagcaatgctgaattccagttgtaacgatttgtagggcttcgaaggcacataatggataatgatgcctttttctttatccgttatcgccggaaccgtaatagcgggtactgaagcatgccggttcggaatacggccaaaggtttctaccgcaatatgagccagtttgtcgatcggttgatgaccatacagcacccctttcatcagattggcagagtaatagcgctggtaaaaatcagtgagtgcagtctgtaatttactatcgggcttatctttcagcgtttcaaggtttccaccaccaaaacgggcattgggatgcgcgggattgagcgtttcagagcggacctgccatatacgatgaccctcaccagcacgggcaatggtcatttcgttatcaatagcatgacgctcacgatcggcgttaaccggatcaagaagcggttcagcaagggcatcgctaaggcgatctgtcgcttctgtcagtgagccattctcaacttccagataaaatgcggtacgattgcttgaagtgctggcattgtgacttccactgtgcttctgcaaaaactcggtgaaacccccagattgagggtatcgcttggagcccatgagcaccatatgctccaaatagtgagccagaccaagctggttatcaggattttccatatgaccaaccggaactgaaatggcagccaatgatttaatggccttctcatcagaaaccagtaaaaccgtcatgccattgggtaattggatggctttatattgacgaagatctcgttcacttttattaatagtttcaggcaaaggctgccaaggcaactttgcatatgctgtggttccccaaaagagcagaaaaagcatcgtcatgatgcgaataacatatttaggcataacccaatattttccctatttatttagatgaagagcgacttaaatgacaagccataggcaacaaataactctgtacttcgcgtttcatacgcacccaaaataattgatcaacttgcctaaatgcgcgctgaacgtaggcatcactgctttcgccactttttccctgtgttcccagccattgctgcatcagtttgttttcagctttttgttgagcttccgcactgaaattgatttcctgactttctctgtcaaagcaatcatccagccatgcccaaccgcttcggcaaaacaaagggagaggttcagacatgccctgaaaataaccggcaaccatctgattcagatattttttcgcctcatccgatgtcaatggtgaaaaacgccactcgctgttttcccttccatacatgcggctctcactatcaccgttgtttcctgaaaaacaataagcaagatgttcaatccatagttggataccatcattggccattaagttcgctggacgccaacgtaaaattccatcgggctgcacctgatgaatttttccagtcaataccacggtatctagctcatggtgtaaatcgatgaaagaagactccgttctctcttcccgaatcttatttgccaatggctgcatagcttctaattgattcagccagtaaacctcaccaaacgccccatgtggtaacccccccgatgcacggagatgataaaacagagattcaggtgatccttcttctatcaagatattcaacaacaattggttaaattgataacgttgcaggtgatcgagtacaaaaggttcttcttcaggcagttccgtctcttcaatgacaaaatgcaccttcagccgacgctggaaaaatgccctgacggggtaacggtaaaaacggctcagctcatcgagtgtcacttcctttatctcactgctctcaaacccaatcggctggcaaaaatcgacgggtgaaacgccttgctgactggccgccggcaaccattctgcggcataactttgctgataatgatcaggcacgaagttttccatcgcaaaaggaacacgagtatgttgtaacagcaggtgatttctaacgttccttgcactgtcatcaacattcagcatctcatctcccggcaagcaacagctctggcagacataatccagtaactcgttgaccaatacggaaggattacactctgtatcatcacgaatcgatttaccgatgtaactaatataaagacacgtttctgccgaaatcagggcttccagaaaaagataacggtcatcatcgcgccgcttcctatctccccgctggcttttttctgccatcagatcgaacccaagtggcggaatagttcgtggataaacgccatcattcattcccagcaggcaaacaactttaaaaggaatggaacgcatgggcataagagtacagaaattcaacgaaccggcgagaaaacgctgactgattttctcatcatcaaaacgcagcgccaattcatcacgcaacagcaccaaaggggcactctcgctgtaatgagcattcagaccattatcaatgactttctgccactgctgagtgatcaatgccaataccagctctgtttcctcatccgcatcaaaaaaagtttccaacagttgcggacatactgccagccaatccgacaacccctgctcttcactcagaattttacgccagcggttcagctccattaaaaattccgccagttgcccagccagttctgcggcaagaccactggattcatcataaggcaaaacgtcattccatgggcctgcatgactgtccatagcataccccaataacatacgtgtcaaaccaaaacgccacgtgttctgcccagtagcaggcaacgacagtgcttctatgttgtcgtcatccaacccccagcaaatccctgattctttcacccagcgccgtaacagacgtaatccatcttcctgaatggcaaatttgctggccaatgcgggcacttccagtaatgccagtacctgctctgccgtaaaacgactctgcggcagctccagtaaggtaatgaaagcctgcaaaacgggatgagcctgacgggctttacgatcagaaatcgcaaaggggatatagcgctcctccggtgcattgccgaaaaccgcctgaatatagggagcataactgtcgatatccgccatcatcacgataatgtctcgtggtgtcagtgagggatcatcatccagaagacgcaggatctgatcctgcaaaacttccacctctctctgtgggctatgacatgaatgaaaagatagcgagcggtcttcaccgtcaatctgacgtttttttaggctatttttgaaagagtgttccgtggaaccaatttgagcgtgatcttcaagattcagcatatcccgctggatttgatgcaggatacaacccggctccagttcaacaaaagcatgaacatcagagtcgggttccaactgcgatagcaggtagaggttatccctgcctaatttcccccatgacgccaacaagggattgttcaggctctgctctccctcatcattgaagagagatgacgcattttctggatctctaaatcgctccagtgactgctggctttgataatgttttggtttacggctatttaacttggccagaaaggcataactctggatatccccccaatagtacagacatggattagtgaacatcagatgaatatcgatatgttgccccaatgccttaaatatttgcagataagcaggaggtaacgtagataccccacagataaatacccgtgcaggcagcttttccagtggaaaacggccttcttgcaaagttgaaatgaatcgatgatataagttagcgcggtgccacagcggttgttctagctgacgggtatattctgtcagttcaagccataatcttttttgccacgcttggttatcacttaacccatcaattgactgatcgctttcccagctttccagccattgagggcgataaaccagatattggtcaaacaaatcggcaactcggcctgccaactggtggatcttacgtttatcgatatcttggtcgagatagtgcctgagagatgaaaactcaggttctgttaacaagccgggtaacagcgtcatcagcttccatttcatggcatccttactgaatgagccatctttaggaacatcaggcaatacctgcgtaaacatctgccagataaaagtagccggcagtggaaattccatgttcgcggcaatccccagtttttctgcaagttggatttgcagccactgtgacatgccggggctttgcactagaaccacttctttgccaaatgggtcggcaaggggattttccccgataaatattgccatcaactccttaagaatatcgagttgatttgaatgataaactctaaacatcaatactcccacttgcacaaaaccagcgttctaatttattagattgattataactttttgtcacattaacggttatttgatagcatcccaaagaacgaaattcccgttgaagttcgattttccacccttgctgtgattcagtttcctccaacaccatctgccctttcaaccgctcatattgttccaactggtcatgcgccaatctcaccgccttaagctgcaaccagtactgctgaaaatttgatgacagtgcctgatggtaacgcattaagcccaacaaagagatcgcaaacacgacagatgccaacataacttccggcaaactcatgccattttgccgctcgtgtcgatggagatggaatcgtttcataaacaaaattcagcctgcggaacagggcagaaatccagccaaccactttcaataggaataagtgtatctctatttgcgtttttcatctgtttcatccattgataaagttcaagagtttcccctgacgcgaactgagccaccccctttaatagaaaaagattatccgcatagtgtttaaggcagctttgcaaatgaaattccggctgttgctggcaaaaccagttttcctcttcctgtgcattgaattgccatgactgcacctttccccattccagcgatgactctgcccgctgaaaagcgttcaggtactttttctcatccatcatcatgagcatggcactctcttgttgataatggagtgctttcaacatcattaagctcagtgccattaacatgagtatcgataccagcaaaatattgccccgctgcccatccacccgattatttccttatattacgcaggcgaactgtcatttggtgacgatatataatggatggagatttaagccagcgggtattaatggacaacgtaataaaaataagcccatttttttcctgtgatttttcaaggtgaaaaacatcaaccctaacctccattggatcaaacaatctttcccagccatttccctgacaattctccacgcctcttttccattcgaggacatgattatttaatcgataaccaaaaaactctgattcaatataatcaggcttctcccattggttatttaaattaaggtcaaaagcaacaataaaacaggaattagcagcttctgtatttttattgttaatcagcaatggttcaccttcacattgttttctgtcccgacaataacccgcacgcctgagatctttttccatcatatagacagttctattcaccagataatggaggcgatatttccggtatagatcgaggatctgacctgataaaaccggataagtttttgtcatagcgataaaaatcacactactgatcaacatggcaaccatgacttcaagtaaagagaatccggtctgttttcccttaaaaaggggtatagccaatgtcatgaaccttttattccctcacaattaggaagttggctaatatcattgctgcatgttctgattcttccacgtcctgaaatcaccacgctaatctctcctgctgaatttgccagcacaaaactggctggcatagcggtgtttctaacaccataaaaatcaatgcgatcactggttgctgatgccaaaaatacatcgtcataaggtgagttaactcgctctccctccccctcatggcaatcagatatcctggataccgaagaaatcagacaccacgtttgtcctatcaccagccacaatgtacgctcctgattcatataatttgccaacccttgttgcctttccataaaagacaacacattctgtaccgctgactgtaaacgcaggcggttttgatattgcccccaatgatataacccccaggatagactcattgaaattaaggacatagctatcagtaattccagtaatgtaaatccagactgtccattaatacttcctccattttttgttgccattgtcttattgccatattggtgtgttttcctgcaacggaatatctttgattcatggggagataaaaaggcggttaattgagttatgcgaagcgcttcgagggaaatatagcgatgaaatgacgtttacattttatttgcggagcggtgcgcagaaatggcaagtcgctattttttaatattgagaacaaccgccgataaatgtaaaaagagcaggctgaacccgctctttaacaatttggtagatactcttcatcttttattgggtataggtttaaatcgcgactggggctttaatacccggatgcggatcataatccacaatctcaaagtcttcgaaccgataatcaaataatgacgcaggcttgcgcttaataaccagcttaggtaacgctcgcggttcgcggcttaactgaagttctgtctgttctaagtggttgctgtaaagatgggtatcaccgccagtccagacaaaatcacccacttccaggtcacactgctgcgccaacatatgaaccagcaaagcataacttgcaatgttgaatggcaaccctaaaaagacgtcacaagaacgctggtaaagctggcaggacagtttacccttcgcgacgtagaactggaaaaaagcatgacagggcgctaatgccattttatccagttccccgacattccatgcagaaacaataatccgacgcgaatcagggtcacttttcaactgttcaaggacttttgccaattgatcgatttgacggccatctgcagagccccaggcacgccattgtttgccataaactggccccagatcgccattttcgtcggcccattcatcccagatagtcacattattatcacgcagatattgggtattggtatcaccattcaggaaccacagcagttcatgaatgatggagcgaatatgacagcgtttggttgtcaccaacgggaaaccctcttgcaaattgaaacgcatctgatgaccaaatatcgagagtgttcccgtacctgtacggtcatcttttgccgtgccttctgctagcacttttttcattaaatccagatactgtttcattttgcctcttgtatcttgttgttacgcgggcatttacaagcccagatcatcattaaaattcctactaaaatcattggaatggaaaggatctgccccatactgatcccctcaaacaacccgagctgtgcatcaggttgacggaaaaattcgacgatgatgcggaatgctccgtaaccaatcagaaacaggcctgaaatacttcccatcggacgtggtttacggataaataaattgagaatgataaacagcactatcccttccagcaccatttcatacagttgtgatggatggcgaggcaggacaccatacttttccagaatcggccataaagagggatcggttgtcgccagtgcgatatcttcgctgcgagaactcgggaacaagatcgcccacggtgtatcaagcgtaacacgcccccacaattcaccattgataaagttaccgatacgtcccatccccaaaccgaagggaatcaatggagcaacgaaatcagaaacctgtagaaagtgacgtttagtacggcgggcgaaccaccacatggcacatataaccccgaccagaccaccgtggaaagacatgccgccatcccagaccttgaacagatacaacggattatcaaggaacattgggagattgtagaacagaacataaccgaggcgtccaccgacgaacaccccgacaaaccctgtataaagcaagctctctacttcgtttttattccagccactgtttggttttgctgcgcgtcgatttgccagccacatggcaaaaataaaaccaaccagatacataaaaccgtaccagtggagggatacaggcccgattgagaatatgacagggtcaatattaggaaatgccagataactagtgctcatcgttccccactaaaagtaatgttgtgtgaatgaatattatctgtacgtcttaagacaaataatcgcaaataatatcacagacagtaaaatggattaagagccatcctacttcaggcgggagcagtatttacacaaaataagctaaatacccccccgcaccaaaccaccgagaccattggcctccataaattcagtagacagggctttcacctgctgactggtttctgctttcaatatttctttgataagcagctcaagatcgttggtatccaaatgacgcagtaaatattttatgcgtggaacacttcggccactcatgctcaggctacggtaaccaaggccaattaagattaacgctcccatcggcaaacccgccatttcgccacatatactcacgggaagaccaacacgctggctttcatcaaaggccagtttcaaggccttaatgaccgcagggtgcaaattgtcatacaaagcggcaacgtgtgtattattgcgatccaccgcaagcaaatactgggttaagtcattcgtgccaatagagataaaatcaatccgtttcttcaactgcggcaacaagaaaatggtggagggtacttcaaccatgatgccaatctggggcagggtaatcgtactgccaattgtctgttcaacttcagctttcgccctgtcgatcaacttcttggcttcatcaatttcttcgatgctggtgaccatcggcagtaatattttcaggttaccgataagcacattggctttcaacatcgctctgagctgaatcaggaatatttccggctgatccagcgtgatacgaattcctcgccagccaagacagggattttcttcactgatgggcatataaggcagttgtttgtcggcaccaatatccaatgttcgtagcaccaccggtttatctgggagaagcgccaacatctcttgataacggtttttctgctcatcttctgatggaaaaccacggtgcagcataaaagggatttcagtacgatacaggcctacaccatcaatactaccacctatctgctgctcgtattttaaacttaaccctgcattgagctgcaccagcactctttcgccatttttgagttgtgctttttgtttcagctccccctcggctaattcgctgagaacctgttcttcttcaataatctgtcggtattcctgaataatcagtggttctggttcaacaaaaacctcgccgcgataaccgtcaaggattagcatccgattatgcagtaattcaggctggatatcggctcccatgatagctggtatccccatcgcccgaaccagtattgcggaatgggaatgggttgcgccatcccgtacaatcacaccagccagttgttcctgtggcatctcagccagtaaattggcactgagttcatcggcaaccagaataaagcgctctggccattcgctatcacctgtgaaagaaccatccagatggaacaatacccgctgcccaagcgcccgtaaatcagaagctctctcccgcatatagggatcttgcaggctggcaaactgttcggcatatttttcgacaacacttttaactgcccactccgccacaaacccgttatcgacggaagaaaacagatcctgcttaagtttgggatcattcagcaaatgagaatagaggtcaaaaatagcggcactttctttctgtgaactggaggtaaaacgcttgctgatacggcgacattcggcggttgcctgctcaagggcttcggtcagccgagaacgttctgcctgatattccagcgttgacgcttcaaaaacttgttcaagtgatggctgcgagccatcttgccaaccctgagccatgacgatgccactggaaatggcaagcgccttaatgcgtgtctgacgatactggccaaatagtccttttgtctgtgcctgagcgagaataaccgccaattgcatggccagcgtgaccataaaagactcttcactttcattgaatagccgtcgttcattttgttgaacaaccagtacaccttgcaactgacgacggtaaacaatcggtacgcctaaaaaagcccgcagaccttcttcttttacttgggggatatatttaaaactgggatgatcgcgcacatcggcgaggttgattaattcagataaacgcccgacttcaccaacgacaccttcatcaaaggccaggctgatcgctcgttcctttggcttctttaagcctctggtagccatcaagtaatagcaataccgctgatgatctgccagatagatggaacagacatccgtactcattgccagacaggtttcattgaccaatagttcaagcgcttcagacaaattagctgccatggcaaccttttcgacaatttcccgtaagcgcatgagcataacagttacctaacttcttctgcgacgatgtaaataaggtgaatgtagctgtggagcggattcctgcactggcatcacaatggaagagaattctttcattacgcggcgatacacatcccgtttaaaagaaaccacctgcctgacaggataccaataactgacccaacgccaaccatcaaactcgggtgcgttgctgcgctgcacattaatatcgacttcattacaaagcaactgtaataaaaaccaacgctgcttctgcccaatacagacgggctttgtatcccaacgcaccaaacgcttgggtaatttgtaacgcagccagctacgggtagatgcgagaacccgtacatctttgcgatttaaaccaacttcttcgaacaactcgcgatacatcgcttgttctggtgattcccctggattgatacccccctgaggaaactgccaggaatgctgcccataacggcgagcccaaaggacctgcccttggcgattacaaattacgattcctacattcgggcggtagccatcatcatcaatcaccagactacctctcgataaaacaaatttgaaaagatagctaattgtttcacactcatctcaagcggtaaacctctatcattggactttgcagccgtagcggaagtctctacaataccgccatctcaacggggtgctgctgttgtaaaaccgcatttctgagaaaaacccgtcgaacctgatccggctagtaccgacgtaggaatttgagacgctaatcattgatataaaagtattttccatttagcactttctcaaatcctttatctatccgctaaccacaacaggagagcaaagtgtttaaaaacttattttccagatttatcgcaatcagtacgctatcgatctctgcatgtgtctttgctcaaacggcacaggccaaacctacactgacaatttacacttatgattcatttgcttctgaatgggggccgggacctgccattaaaaaagcctttgaagcagagtgtaactgtgaactgaaactcgtcgccctggaagatggagtatccctgctgaaccgagtgagaatggaaggcaaaaagacatcagcagacatcgtgttagggctggataacaacttgattcaggctgcccagcagacagggttgtttacaccaagccatattgatacctcaaaactgaaattacctgtcacatggaacagcgcaaccttcattccttacgattacggttactttgcctttgtttacaacaagaacaccttacctcaccctcccaaaagtatggatgaattaatcaacagtaaccagaactggaagattatttatcaagatccgcgcaccagcacccctggcttgggtctgctactctggatgcaggatatttatggcgataaagcggtacaggaatggccgaaagttgccaaaaaaacgctgaccgtcaccaagggctggagtgaagcctatgggctgttccttaaaggtgaaggagatatggtactcagctataccacatcaccggcctatcacattctgtcagagaaaaaagataactatgctgccgccatattcagcgaaggccattatctgcaaattgaagtcgcagctcagttagcctcaagtaagcaacctgaactggcgcagaaattcatgcagttcatgatttcacctgcattccagcaggcaattccgacgactaactggatgtatacagttatcgacattcctctgcctgaggttttcaagaagcttcctgtgcccgaaaaaccactgcaattcagcgcagatgatgtggccaaacaccgtaatcagtggatccgtacatggcaaagcgccgtaagccgttaattgcgggttggttattgccgggggtgattgcctccggcctgttacttgtcgttgctctgtcagcatttggagcgctttggttcaatgcgcctgaaagccactggcaagggttcttagacgacagttacctgtggcatgtcattcggttcactttttggcaggctttcctgtctgccgttttatcggtgacgccagcgattttcctcgcaagagcactttatcgccgtcgttttcccggtagagcgctgtttctacgcttatgcgccatgacgttggtacttcccgttttagttgccctctttggcatactgaccgtttatggtcgagtcggctggttggcaaatatttcccaatggatgggtattgaataccgttttacgccttacgggctgcaaggaattctactggcacatatttttttcaatatgccaatggcagcccggttactgctccaatcgctggaaaatattgcgatagagcagcggcaactcgcagcacagcttggcatgaatgaatggcagcactttcgttttgtagaatggccttatctgcgccgtcaaattctgccgacgggtgcactgatattcatgctgtgctttgccagttttgccaccgtgctcgcactgggaggcggccccgcagcaaccaccatagagctggccatttatcaggcactcagctatgactacgatctcgcccatgctgccctgcttgcgcttatccagctattttgctgtcttggtctggtgctggtcagccaaaaactcaaaggcacactctttgtcggttacggtcaccagcaacaatggcggaatccgcaggattcatggctgcaaaaagggtgtgatgggctattcatcgttatggcactactacttttgatcccaccgttactggcggtcattgtggacggtctgaacggtgctgtacttaatgtcctacaccagccagctttgtggcaagcttttacgacttcagccattatcgctctgggagcaggtctgctgtgtgtcatgctgactatgatgctgctatggagtagccgtgaattacacttgcgtcactctcctcgctgggggcaggcaatggaaaccagcggtttattaatccttgccatgccaggcattgttcttgcaacaggcttttttattctgctgaacaccaccgttggcttgccgcattctccttacggattggttatcttgaccaatggattaatggcgatcccatatgctctgaaggtattggataacccaatgcgtgatttagcggagcgttacaatcccctgtgccgttctcttaatattcaagggattcaccgactacgctggattgagcttaaggcactgaaaattcctttggctcaagcactggctttctcctgtgttttatcgattggggattttggcgttgtcgcgttatttggcaacgaagatttccgcaccctgcctttctatctttatcagcaaatcggggcatatcgcagtcaagacggtgcagtcaccgccttcttgctgctgcttctctgttttatcttgttcagtgtgcttgaacgcttaccgggccgacgccatgattaaactcgaaaatgtcatttatacctacgaacaccttgccatgcatttccatgtcaatattgaggcaggcgaacgcgttgcaatcctcggccccagcggagcgggtaaaagcacgctgttaagtttaatggcaggattccaatccgcagaaagtggcgatatctggttaaatgatgaaaatcatacccatacctcgccttccaaacggccagtctcaatgttgtttcaggaaaataacctgttttcccacttaactattgagcaaaatatcggtctggggttacaccccggattacggctaacgggtgagcaacaaaagacgctacagcaaattgctgcccaagtatcactgcaagattatcttaaccgcctgccagcccagctttccggcggccagcgccaacgcgcagcactggcacgctgtctggtacgccagcagcctattttattgctcgatgagccattttcggcacttgatcctgctttgcgcaatgaaatgttggagttactgacgcaagtttgtgatgcgcgccggctcactttaatgatggtgtctcataatcttgatgatgccgccaaaatagcaccgcgttctttacttattgtggatgggcggatttattatgatggtgcaacagcgaagttagttaatggggaagcgcctgaggcggcgattttggggataggatgagtggttaaatgacaccatctgtgccactccatgcagccatgcccctgcctgaagtgccattgattcagatacagcaatttttattatcttatgccaagtaagcaactcatcatcataaagccttagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacaccatctaatcatttaaaaaaatgtcatgatttctatatccgtaatatctacaaaccacaaacacttgttataaaaagaaaatacaaaacagacataaatcgaaatataagtatttcctatgctaaatttgtaatgaaatcattcaaagctatactccaaactgcaagagttggtttcgggttaagacactctaatcagaggacacatatgatgaaaagcttgaagttatcagttgcagcattactggtgttgttttcaagtacagcacttgcagcgccagcagtatcactcgaacacgcttcaaaaacagccaccgcggtagaacataatgtcaaaacggctaaagacaacgttagctcattagaaaagaaagttaccaaaggatcaaaaagccaaaaagcgtcacagaaaaacaacagtaagaaatcaaaagctggaagcgcagagaaaggggctaatagcgccctttgtaaagacggaacctatagtaagagcaaaacccataaaggtgcatgttctcgccacggcggtgtagctaaatggttataaatttccgttgattctttataatacctaattagggagcttcggctccctaattatttttcaatatgaatcgcatttttttaactggaaataatggtatactccaataacttaattatttattcatcaatctattcaataatatcatgatgaataaataataaattaccatccaaccagaaaaaatcggaataataatgcgattaactgacgataagaaaatacgaaaatcgataatcaggttatttacctttacagaacaaatcatcatgcttaagagctttagattagttaagcatgaaaccagagatgatttttccaattggttaaagggattagcctataattttatggaatcagcaaaaaatacgacgttcttttccattatcttggccgtttttacttatatcagtccaccaaaatcacactatgctgttttaattttcaacaatcttatttttatctatcctgttttttatgtttagctaagttaatcaatgaaattatctgcacttttgttatagtcggtaatacaatacactgacttaccgcgtccactaatgaaatcgaagatagtcctttctgagcctgaacgaatcacgttgcaacaactcgccctgaatcatcagcatcggggcatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatgaaacggagttcgctaaaaaatccgtcttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttgattacttatattgaataaagccagaataattggatgtggctaccttgtcggcataaaattatttatattctgcattaatcacaaaatattttttgtaccggaatcacaaaacaaggcttacccgcccctaaatacacaggggatcaaaatttatattgacgatgataaaaaagcaagaaaacgcatcacagacatttttacatttaaagagcaattaactctgttacggtgtttttctttggagagagaaaatactcatggagattttctggcttggattaataaaacttcagccgactttttttcgtcgataaaaatgatgttaattattctatttatatttttcattatttccataataaaatactatgaagcttggaattatatacttgtcactttctttatttttatgatgcctttaatgacattaatttgcatattttttacatctcacatgatgggctgtaaatttatcacaagtgtaaaattactttattttcatttaagaaatgaaatataattaataaaatttatccacatcgataaataaataaaatttacaaactgtatttgcaccgtgaaaatatagttgatgattattcattaattgctatttttatcattcctcatttttacattgattaaactaataaattccgttacaaaaaatttttgctttatagaaataccattctgaatagatgattatctgggaatatcttattaagattgtcttaataaactatgttaatcataatattaatttaattataccattagcttaatagaagcaatagacgattaaacataaataaaagctccttttctaaaaattagacttaaatcacaataatgatctatgcagcaaaaaccgcgtatttacgccgctaatcctataaaaacattaaatcaacaacacgattaaccggataaaatcctaataatcattacactaatttactgaataaaatgaaaaatataggttattgtcagtaatgtgctagcattcgttacagaaacgaactttatgaatggtgaataatggtagccagatattgattgttctgctaatattcgtatgttttttatccagagcaataaaacgaggagaagcaaatgccctctttaatcatgaggacaactgccgtcttcgctttctttctctcattaatttttaccggtctgagttatgcttcgaccagtacctcaaaaatgaaagagtattctcacaatggcatacaggagagtttgccagatttgcgacaatatccttcaggtacaccccggaagaaagcgtttttaaacattgttgtccctgtcattgatgagcataatcaaaagattatgcaagaccgaaaatggctgctgtcacaccagaaaactcgtcactggtctgtacaggatatcagtcgattgcagaaaatctgcgcaagttacaaaatggcctgcacatcaccgaaacaggtcaattggaacaaactgttaagtcgagttgacattataccgacccattttgtcgctactcaggcagccgcagaatcgggctggggaacatcagaacttgccaagaaaaacaataacctgtttggtatgcgttgcaactcatgcagcaaaaccaaaggaaaaatcaaaggttattcggtttatcgcaatgttgatgattccgtcatcgcctacatgaaaaatatgaatacacaccgtgcctacgaatcacttcgtacttcacgggcaaaacagaggacaacacaaacgcctctgaataccagtaaattgatcgataacctgaacggttattccgagctgggagctcactataatcgctatttgcatcaggtatttaatggcaataaaaagctgatttcacaggcacaggaactgacagacccatagagacgggtaaatttataccctgcatctcattctttcaagttgctgcttttgttagctgcgatcacttaccaccgcgctgtaacttgaaatctattgggtatagattaacgtgccagaaataatcacctacgtattcgtaatgcctttcgtattgtttaatgttcaatcattattaaataaaaaggcaatgaacctgcctatacggcaggctcccaataatccgctatgtattaattacacagcggattatttttttataacttctctgcctgctacctattgtaaacacaagtaaattccatactataatgaacctcagaatcactccctttctctcaatgatagatggttagccagagcctaatatgaatttcttttcttttgagtttcttggttcgtttgttattctgcttcttgcctattggcttttacaaaaagcccctaagctacagaatggcttattaattttagttagttatttatttatcttctctttcgcagcaaaatttgcctatattctatttgcctataccctgttcatttactttttggcgaatattctcagtcgttatttgtccaacaaggccatattcacgctcctgattttcggtattgtgggttgttttaccgccttcaaatattattctttctttcaagagacgattcagcaatcattagccaatttaggaatttctgtcgaattgcccatacttgagctgctgatgccattaggcttatcattttatgcctttcactccgtcagttacgtgatgtcggtttgcaagaaagaactacctcctgctccgctgcttgatgttattttgtatctctgcttttttccaagcatcgtggccgggccaatcaatagagccaaagatttcctgccgcagatccaagcttcatccagagtgatgctggagccattcaaagctctgttattgattgcactggccatcgcaaagctgtttctgctcagttcgacgctctctgaaaattttgttaatccagtctttgatgaccccactggctatcatgcggggcaagtccttgtcgcgatttatgcttatgcgtggaatatctatttcaacttttcaggttataccgacctcgtgacgggtattgccctgctgttaggttttacagtgccacagaactttaatgccccttatcttgctgagaatttacaggaattttggcggcgctggcacatcagcctgtcgacgtttatccgcgattacgtctacattccactgggcggtaataagaaaggcactgtccgcaagaatatgaatctattctcggcaatggtcatttccggtctatggcatggtgccggattgagctttattatttggggcgccattcatgggttagggttaattttccacaatattaaaaacgcactgtttccctccaccggaaatcgcaataagacgcgaagaaaaaatccgatttcattatttttatcacgcgtgatgacattccattttgtctgttttgcatgggtattcttccgcagcccaacatttaatgacgctctggttgtattaaaccaattgtgctcaggagatgtgttcacggcgctgttgtccagcagcactttattagtcgctttttggggattctttattatctatccttggctggtgaatatcagagacacgatggaaaagaaccatagcctgatgtcatgggtttattacccaatccccttagccctgatcctcactttagtatttatgctgtcaccttctggaatgccaggatttatctatgccaacttctgaatttatctctaatcttaaaaaagtcgggcaagtgatgtttatcgtcactttaaccagcctgctgctgatctggctgaatcaacgttcgctggatagtttctggcaacagaagtatcatcgtaatagtccgtggacagcccttaagggagagccagtgtgggatttgggcagcaatatgcagcaaggtgccattgccgccggtgaaatatttatggcatatgtaagggggatacatcaggataatcagcgacaggccctgaatattaatgagactccaagtataattcttcctgattttcaggttggtctgcgttttctggaaggatatacgtactcgatcgagagtcgctatttgacgttccctgatttgctgcacaaagatgtccggcacactcaatcatccttattacgaaatcattcaccatcaaatgcggttatcgaaattaccccaaaaaccaatgtcagtttggggaaaaaagatcaggtactgtttgcaggggattcgatgatgcaaggcgttgctccgcatttaaaacgccgtctttaccaggaacatggcatcgccagtattaatttgagcaagcagagtacagggttggcctatcccggtttctttgattggcccaaaacaatcggcgatacactaaggaaaaatccggatattaaattggttgtggtgtttttaggccccaatgatccctgggatatgccgacaaaacgcggaggagcctatttgaaattcgcgagtgaagattgggaaaacctttatcgtcagcgaatcgaaacgattttaaatgatgctcaccagcataaggtggatgtgatttgggttggcccacccaacatgcggcagaaaaaactttccggcggcatggcttatctcaataaattgtatcaggcagaggtggcaaaaatgggtgagatctatgtctcagttaatgatatgttcaaatatcggtcggagaattattcagactatattggtgatggcagtagtacaatcaagctccgaagtggtgacggtattcatttcagtttgaatgggcagcagaccatcgcgaacgctatcttttcattaatgacatttattcaggagccagttaaaaaagatgcaaccatttagaccgttccgttggttttatcggataacgggtgcaggtctggttatcgcgctctctgtgagcctattatcatgccacggcaaaaaatccaaaccgtcatctgaattgcagacgacgcaaatacatcgccaaaatcaactgacaaattttggcgacccaaatttcccattactggcggataagctgcgccatagcaactcgcgccaactccatttcgtgcaactgggcgattcacataccgccgccgatttttttaccggcaagctgcgtagtttattgcagaatcgctatggtgacgctggccctggttttatcagcccgatcagcattcccggccagcgcacggcgaccgttaagttcacggatgataaaaaaaactggtggctttcgagcagccggaaagataaccgtgctgattatccactggggggttttattgccacaccagaaaatgtcagcagcacaatacggatgaatttatcaccctctgcttttgagaagtacgggataagcgcgctttatcaatcccatgaggcaagccaaatcaggacgcagtttagccagtgggatctgccggccacacaaagcgaatggcagttttcgcaacaacacagtgtttttttcccactcagggtcgatgcacaggatacgcatttgaaaatcggtggctggctgatcaaacgccaaagctccggcattatgttatccgcgttggggattaatggcgccaccatcagtatgttggataaatggcagccacagtggatcaatacactggtccaattgaaaccggatatggtgatccttgcttatggcaccaatgaagccttcaacgattcactggatcttgttgcctatcagaaggaactgacatcaaaagtgcaggaaattcgcaaagcgatgccagaagtagttattctgctgattgggccaagtgattcgctgaaaaacaaaactgccgtcagttgtgccgaacaacaacccgctctgctcaatggcataattcaggctcagcaggccgtcgccaaacagcagcacaccctgttctggaattggcaggagtttatgggtgggtcatgttcaatcagaagctggcagcagcagaaccttgctcgtcccgactatgttcatctctccgccgcagggtatgaacgcagtgccgaagcgctttatagccagattgttggtttgattgagcagtgaatgacaaagtgtggaaagcaaagacattcagtggaataaatgcagaaccgtagtttcagcaggttatccccgtacttacagggaacacttcttctgtttggtttaatccagattcccactcggtttatccccgtacctacggggaacactaaatataaccgtctgttttaaatatattttattagacgtaaaaattctaccacgttaaatcacaaaattaaccgagggaaattctgtgatttttattcaaatcacctcgccatccccacagcaaacacccatcggattttttattgaaaaacccgaaaataaatataaaaaaacggcattttaatcagtcagtaaaatgccgttagcgatgtttcagggaaaatttaactcagcatggcaaaatagatcatgccgataatggcacccgtagtacccaaaatggtttccataatggtccatgttttcaatgtctgtacttctgtcgcaccggtaaacttaccgaacagccagaagcccgaatcgtttacatggctgagtatcaacgaaccaccagcaatacacactgacaacgccgccatttgcgcaccggaataacccagttcaccaatgactggcagtaccagacccacagtggtcagacacgctacggtagccgaaccttgaatcacgcgcaccgcccctgccagaataaaacatgccagtgcgattggcagaccagcccccaccaaagcattaccgagcgctggcccgacaccggaatccaccagcacttgtttgaacacgccacctgcccccgtaaccagcaggatgatccccgcaggctgaatcgccgcagagcacacttccataactctgtctttactcataccgcgacggatcgccaagccataaatcgccaccagacaggcaattaaaatcgcggtgaaaggatgaccgacaaactccagccattgatacaacgttgactgctgatcgacgaaacgtgcagcaatagtcttcaaacccaccaataccagcgggaataacaccagtgccaggctgaaaccaaaggaaggcatctggcttttgccaatgctcggtgtattcagatcctctggtaattccagtgtcacatgtttactgatgaaattgccgtacatcgggccggccagcaacatgccggggatcgcagcactcaggccaatcaggatcatccagccaaaatcggctcccatctgagaagccagcaacatcggcgtcggccccggaaccagaaacgccgcagcggctgcaacaccggcaaacagtgggattgccagtttcaccacattaccgccagtacgacgtgcaacggcaaataccacgccaatcaacagcacaactgccacatcaaaaaacagtggtaaggcacagataagccccgcgatgcccaatgcataattcgcgcgtttttcaccaaaactacccagcaatttcacggcaatctggtcaagcgcccctgtttcatgcaggatcttgccaaacatggcacccagcgccaccacaatggccagaaagcccaaagtacctgacatcccgttttgcatagtctgggtgattttttccaatggcataccggagaagatccccgctcccattgaaaccaacatcagagcgataaaagcatgcattctggctttcatcaccaaaaacaatagtaggagaacagaaccgacggccgtcagcaccaaagttaatgtagtcatgaatgcccctcggtaatgcgatcaattgttgttattgtgtttttgattacttcatcaaggtctggtttgatatcaatgtgatagacatctttttcatcgtcagtcggctcttccaatgcctcaaactgcgagatcagcatttggggtttgaagaagtgtcccttgcgagctttcagacggctttcaattaaatcaaaatccccctgcatatacagaaatgacaggtttttgttgccattacgcagcatatcccgatagttttttttcagggcagagcacacgagcaaagagacattatttgtacgctgcatggcaaaaatggcatcgttgagtgcttttaaccacggctgccgatcatcgtcattcaaagcgtggccttgtgccatcttaataatattggcgcggggatgaagaaagtcaccatccagaaacgccgcgcccaacttacgagcaaccccactggcaaccgcagatttaccgctgccagatacccccatcaatacaaaaacatgatttggctgttgggtattgctcatatcaaactcctttgtgcagatcttgttacttggctatctctgtgatgtacctgcaaaattttctctatgaaatattatccataaaatgttaccggtaacttattatcagtaacattaccagcaacacaagatcgcgagcaattaatcaggatcggaaaaaaaagaaaatgtgaagcttatcgcaattgaagataggaaagcatcattttgatctacaaaaattaaacactttctcccaatgaaagcgtaaatccaacatcaataagggtttgttccagtttttgtcccttcaaacgagcaaacagggcttccgccgccctgcgtccgatcagatcacgcggagtcagtacactggccaattttggcatcatcacctgaccaacatcatggccgtggaatccagccacagcgatctgttccgggacattgatcccctgtcgctgacattcaaaaatcgcaccaatcgcgatatcatcattggtgcaaaacagaccatcaacatcagggtatttctggcaggtttcccgcaaaagctgcgcgcccagtgaataggacgaactggcaggcgtcatcacattcctcggctgcaaccctacgctgcgcatcgccatttcgtacccatccaagcggatcagcgttcgttcatcctgccgcgctccaaggtagatcacgttttggcagccacgttcgatcatagccaccgtcatctgccgcgccgcctcaaaattatcgatcccgacagcaatatcaaggcagggagagacgctatccatcagttccacaaccggaatgcctgccgtctccagtaccttcaaggtcttgggcgtatgcgtccgctctgccaagatcaggccatcaatattgtaagaaagcagggaaagcaggcgctcttcttctttctgagcggaataaccgtaatgagcgagcatcgtctgataaccattgcgatcagttacctgctcgatcccacgaatgacttcggcaaatacctgattggtcagtgaaggaagtaaaacccctatcgttcggctggtagcgttggaaaggatatccggcacacggttgggaatgtaacccagttgatccaacgtttcagcgatccgttttcccaatgcttccgagacctgatccggattacgcaagaaacggctgaccgtcatttttgtgaccccaacgaggtttgcgacatcttgtaaaactgggcgttttttcttcattttcaatgtaatgcaatcagctatctatatacagactaataaaacgcggttttaacacatttacacaccataacaatacgatttttagcaaaaaatgctggcttactctcatctcatagagctgtagttatagaactgtgatcacttactctgtctgagagaattccgataaataatttggggcgtaaattctgggggaggtgtatcaggttcgatcaataaacgcgtcgcgaaacacgccatgtcagtaatgggaaaatggacgctagtcagtgcaggatagacaaatgccgctcgctctccgcggtcataacagatgatagagatatcctctggtacacacagccccagctctgtaatcgccagcaatgcgccgagcgccatctcttcactacagaaaaacagggcatcaggccgtgattttgccagaatggttcgggtttgccggtagccactttgcagatcatactccccttccagacaagcaacaggattcaatcccgcatcctgcatggcatccaagaacccttgacggcgctgctggcttggattgcgtgacaaagggccactcacgcatgcaatacgagtatgtccatgctcgaccaaggtttgcgtggcgagatagctggccttgtggtgatcaaacacaacacagcgcggctccagccctgacaccagacgatccagcaacacaaacgaacggccactttgagcgagttgcctcagcttatcatcactgatggcacgcacatgtaaaatcatcccgccgcagcgcaggctatgcagatgcataatagcctgccattcgttttcagcacgatttctcccctgcatgaccagaagctgtttgccatgtgattcagcttccgtctggatgctatccatcaaggcaccaaagaagccgccacgataggaagtggtcaccaaccccagcgtattgctctgatttgaagccagttcacgcgccgccagattgggactgtaacccaattctacgatggcattctcaactttggtacgggttgctgccttcacttttttgtcaccattaacaacgcgtgacaccgtggcgcgcgagacgcctgaataactcgccacatcttccagtgttatcatactctttccttgttaactccatgctcctattcctgatcgacgcaacttaccgtttaaactggggcaaatacatgtgattaatctctaaaatttcattcaataatgacgaatccaacgccgcatcgccaatcaacggatgggttaccagcgccagcagtgcgaccttgcgatcaccgtggacggcggcttcgatggtcaggcgctcaaatgctttcacttgctgggttagggctgacatactgtccggcaggtgaccaaacgccagcgggtgcgccccttgagcatcaacaatgcagttagcttcgatcaccgcatcatctggcaggccgatgatagctccccgattcgccgtattgacgaccaattgcgtaccgagattattatgaatagccgagatcaattccaacgccacttcagaatagaaagatccgccacgaaaactgagctgagcgggcttgtgatccagtttaggatcggcatacaactcgaacagctcccgctccgcttgcatcacctgctctgcccgtgtccctttgcttgccgcgctttctttctcttcctgtaacatcttgccggtttgatagaagtagcgatgatacgggcagggaattgcgcccaatgcctgtaaaaactccggcggccacggttcttccttgatattgttcatcgtcagctctgcgccattgcacagtaattccaatacctgatcggtttcatccctgccattcactaatacctgatgtacccagaccatatggttaaggccagcaaaacgtaattgcacgtcctgatatggccgttgcagcatattggcgatcatatggtgcatcgagattggcacattacataacccgatgatcttggctttgctatagcgggaaaccgcttccgtgacgacgccggcgggattgctgaaattgatgatccatgcctccggcgcaaggcgttcaactttatgagcgatatccagtaacaccggaatggtacgcaatgctttggcaaacccgcctacgcccgttgtttcctgcccgagcaacccatatttcaaccccagacgctcatcagcggcacgggcaggaagttgaccaacgcgcagttgagtgagtacgaaactggctcccttaatcgcttcatccggtgaataatgcaccgtgacagtaacataatccaaatcatgacgatccagcatacggcgagtcagcgcagcgatgatttccagcttgtgccgcccagcttccacatccaccagcgccagctcagaaagcggaatagtttggctacgctgaataattccttccaccaattccggtgtataactgctcccgccgccaataacggcaattttgatcggtttcatatcatccccctgttattctgactggcgatcttgtggcggcaagcgctgataaagatcgatcatattgctggcaagatcttgaatcaccatcgcattcatcaagtgatcctgggcatgaacagtaatcagattaatcggtaattttccgcacccttcatccaatccgatcagtttagtctgaatagcatgagcggcacgcgtttcctgtcgcgcttcttccatcaacattcctgcttgctgaaaatctcccgccttcgcctgttgtaaagccattaacgcactgctgcgcgcactgcccgcatgtaccagcaattcgacgatctgttgttcaaaatcctgctgttcaaaactaatattcacactgcatcctccggaggttattgctacgcctgagcgtcggcgaggctttttgcctgctgttgttcttctgccaaaagctgtttttcatatactttgaagaagggataccaaatcagcagatcaatcaccatcaacagcccaaccaatacgaccgcacggtaatcccacgcggcggaaatcagcgctcccatcggcgcgggtgctgtccacggcgcaatcgcgatcatcttctgcaccagatccagatgcagtgcgccataagccaagactgcattaatcagcggcacaaccagcagcgggatcaataacgtcggattcatcaccaccggagatccgaacagcaacggttcattgatattgaacatggcgggtacaacactcagtttgccaatggttttcaggtgaattgagcggctgcgcagatagaggaacgccaataccagcgtagaaccagagccgccgatacagacgtaaaaagaccaataaggcgcggtcaggatttgagtcgttgccatgccctgtgtcatcaaggcggcattagcggcgatattcgccataaaaatgggattcagcagcccagtgacaatattgtcgccatgaataccggcgaaccacaataaattggcaatcaacaccaccagcataacagcgggcaacgtatccccgatcgcaatcaatggttcaaatatctgcataacagccgcaggcagcagcaaattaaattcgctttgcagcagcagactgatgggataaaccgtcagcaaaataccaacaacggggtacagcagttcaaaagagcgggcaatggcaggtggaacctgtgatggcatctttatcgaaatattgtatttttttagcaaccggattaattccaccgaccaaatcgcacagatcagcgccgtaaataccccagttcctcccagaaaatcgagcggcattttgttatcaacctgcggagccgccgccagcagaaatgccatcaacgacagtaaggccgatgtcagtccatccagtccataagatttcgccagactataagccgtaccgatggagacaaacacactcatcagtcccatcgtcataaagaaaggcatggtgatggttttccaatacgctttggcgaattccagccaagcctgaccaaaagaagaggaggtttgagcatcaaatggcgggtttgccacaatcaacatgatactgccaataatcagaaagggcatggccgagataaagccatcacgtatcgcaataatatgccgttggctaccgatccgtccggcaatgggcgcaatatgattttctacaatacgcgtcaaggaagtataaaaactcataatccactccatctgatgatgaaaaggttattccagcaggcttaaggcgtgatccagtaccttatcaccacgcagtgcgccgtaatccatcatctcaatcaagctgatgggtttacccagtggctcggcaagagcggtaaatcgaggcagttcatacttgatttgcggccccagtaaaatcacatcggcttcattgatatacatccccaactccaatgcgggcactgccttaatggcgacttccagcccccgtttttccgcttccgcctgcatacgctgtaccaacatgctggtagacatccccgccgcacaacacaatagaatggttttcatcgtcttgttctcttcgttgttgtcccattatgatttcgtctaattcgaaaatgagagcgctctcattttagttaaggctaacaggttatttttccgttgctgcgatgaggttcgcataatagataagcaatagcttagaaaacaaacaaaatgcgatcagcgttgcagatgatcagtatggcaaaaaatacggcaggaatttggctgatttaggtggttaaaaaatggtagaattttggaggtcaaaaaaattgttataaaacagatggatgaaattagagtgttccccgtaagtacggggataaaccggttcatatacagaatcttaagtaccaacggcttattttagatacaaaaaaggcttcatttatgatttgataatcgtcgccaaacaaatcaccaaaatcacggatgaaaccgatgattgctgtaaaacaccaattaatacaattcattaatgaggattctttgtaaaagattaagttaaaaaaacaatcaataacctattagaagtatcttatggaacttgaatagtacctcgtatggctcgtattcctatattttttgacttttaattttttctttttcattaatatatttttaattaaattcattataattaataaatttaatagcatattaataatctattttaactcaaaataatttcttgttaatattatataatgcacaaaatgtttggtgtgtaagtataaaattacactttagcacctcgaatacaaagggtacaataaagaaacttatataaaaaagaataaaaaactgtatgtataatgcaagttatttaatttattgacgtcaatgatttatgttataatcactatgaaaatattttttatttaatttcaaatgaataaggagaaaatatgacacgaaaaagggggagacctctcaattttgacaaagagttggctcttaaaaaagccatggatattttctgggctaaaggatttgaaggaacccaacttgtagatttaacggcagttatgggaattaatcctccgagcttctacgccgcttttggaagcaaattcaatctattttgtgaagctgtacagctttatattgaaacaataggtaataaaacagtaaatgcactaaatgatgcaaagacaacgaaagaagggcttaaggccatgttagaaaattccataattaacgcatcttcaaatgaagcaggtggttgcttaatgataatgggaatagtcaataatcgtgctgaaaattaccctgcttgggagtatttgagagaagagcgtgccaaaacccttacactgatacagttacgtattgaacgcggtattatggaaggtgatttacccaaaaatactgactcaaaaacattggctgaatattttttgggaattacacaagctatttcatttcaggctagagatggtgtatctaaaaatactttacagcgcctaattgaaccagctttagccgcattgccttcatccaacacactggagtaaaaaatatatataacaggcaaactttattctaaaaataattcattgaaagctgtctctgttacaataactttataatccaatttggtatttataacgtggctgcctaggtagccactatcaaattattcaatacgttgtaatatgataatccctaccattttaatcgtattcatgagaaattcccccgaaatttaatctactcagtaaaaggtgacattgattgaaactaaaaaatcaacaatgccactattgcaatcataaattccatcgctttacagaacaattgcgattttaatattaactaaaagtaatattttctgataaataaattcactattaattatagtctatagtcggatgatttatagcacttgtatcatagtaattatggtggttagctaccatcataagaaacaaggtgagcctcatattgcacatttaagcgagactttgttaataagcgaaggccccttgtttcaccttccacgccagcaccaatattgaacggtaaccaagagcaacgactctgtatatacaagtgaaattggcgtgatggcatcaaataagaggagggttattatgtattatgtcggaatagatgtcagtaagaataaactggatatttgtttgttatatgatggagttaaaggtaaacgcaaaacaaaatcccttctgaataatgaacattcagcctgtatgttaatagcgtggctagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttagccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctgctaaaatccgtgctaagttgtttatgtctgcactcactgcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttgaccatcaagacggtagcttattacaacaagaaaaacatctcccagtttcgtttgaaaaaaacatttttatggtcggtctcaacgtgtaaaagagttcatctaatacatttttccttgcttcaagattcagtatagaattcgttttatttattcttatttgttgaatttaaacaattttattgcctatttaaacgcaattttttagctaggtctacagagccgcctctcttagttttttatctctttttgtatttatgtaatctaaattacataattaaatcaagatagaactttatctcaaggtttactgcttaataaaggaaaaatatttatgcaaaatacatctgtcacagacaataaaagtgaaacattgccattggctgtgtacatactggcattcggtatttttgctttggtgacaagcgaatttcaagtagcgggtatgataccggttatggcaagtgatcttggtgtttctatttcacaaattggttacctggtatctttgtatgcactagcaatggcggttggagggccattgctttccataggactattaaaaataccacctaaattcgcacttatgattctttacgtgatatttaccattggtgaggttttaggaactatagcgagtttgtatcactttcttgtagtagcgaggcttattactggtgctgcatctggggctttttatggagtagcgatagcaatctgtgttgaaattgtatcagaacataaaagaggttgggcaatttctattgtgctagctgggattatggcagggacaatactaggtttgccaatggccaatttgattggaacacatcttggttggagagagagcttctgtgttgtaagcgttttagctgtgcttggtttaattgtcagcatattatggataccaagccttccaaagcagcaggcaattggcctaaaaagtgaattaagcgctctaaagagtcctagattatgggctgtattctctacaagtttattaataatcggcgctacattttctgcattcacttatttcacacctatattgaaaaacattactggctatagtgatggtgctgtcgctgtactcctgactgtttatggaatagcaactatgttaggtaatatcgttgttggaaaattagcagatcgccatacaataactattctggctgttagacttgccttactgacaattttccttgccttatttgctatttttgctgagaacaaattaatctctgttctgtccttaataggtattggtttagttggtgtaacaatgaatccggctatggttacacgagtaatcagaactgctaatggtcgtcctctggtaaacactattcacacttctgtaattacactaggcattgtcattggagcatttcttggtggtttaggtattagctttgaccttggtttaacatctccaatgtgggttggctttttcatggctatagtcggtttcacaacgctaattccagatttgcagttataccaccgtgaacgagtaaaactgaacagctaaaatacatttaaaggagaattcatgtctaatctttctggaaaaatcgctttaataactggtggtagtcgtggaattggtgcgggtattgccaaacgtttagcacaagaaggggctgatgtagtgattacctatgttaataatagtgatgcagcaaaagcagtagtagaggatattatcaactctggtagagttggtaaggctattcgagctgattcagctgatgctgacgctattaagttagcggttaaacaaataataaagcagtttggtcagattgatatattgataaataatgccggtcatatggatgtgagcggaactccactgccacacgtccctttagatgtagttaatcaaactatcatggtgaatattcgaggttcttatctctttgctcaagaggttgcttcccatatttctgacaatgggagaataattaatattggaagctgtttaggtgagcgaatgcctgtagctgggcttactttatacgcaatgagtaaatcagcaatggttggccttaccaaagggttagcgcgtgatttagcgtataaaaaagtaactgttaatcagatatctccagggcctgtggacactgacttaaatccagcagatggacctaatgcagatttttttcgtgaattaacagctttaaaacagtatggtacaactaatgacataacctctatagtgaattttctggtaagtcgagaggcggcttttataacgggggccaacattgctgtggatggaggtatgaatttataatgttatcattatctatttttatgtcttttaggagacaataaaaattaggaatattggcgctgttgtaagctacagtgccacgcgtttcctgtcgtgcttcttccatcaacatttctgcttgctgaaaatcttccgccttcgcctgctgtaaagccattaacgcactgctttaatggctacctccagccctcttctttccgcttccgcctgcatacgctgtaccaacatgctggtagacatccccgccgcacaacacaatagaatggttttcatgattttgttctctttgttgttgttccattatgatttcgtctaattcgaaaatgagagcgctctcattttggttaaggctaacaggttatttttccgttgctgcgatgaggttctcataatagataagcaatagcttagaaaatggacaaaatgcgatcagcgttgcagatgatcggtatggcaaaaatacggcaggaatttggctgatttaggtggttaaaaaatggtagaattttggaggtaaaaaaattgttataaaacagatggatgaaattagagtgttccccgtagatacctgtcccttgatcagatctccaaatcaaccgatttagccagcaaatagccgtctatcagggtttgcagccgaaaccaaccttcccaaagtcgttcccatccgactcgacccatgcgtttggaatcgtaccagccggccagttttcccagattgatgaaggcccaatgcaaactcggggcttttttcggcggacgccgtttttcttgttttgaccacagtaatttccacgccagggggcttaatactgtctcaccgctctctttctctgcctcttctttgttcagacccataaaacggagctggtgtatccgtaccgcaataaaggccagcagcactatcatgcgctccagattatctttgctttgcatacgcagcgcttctacctgcgtgtcgcccgttttccatgctttgtgaaattcttctatcagccagcggcgctcgtaataactgaatattttatgggcctcttcctgactgttgacgggttcggaggtcagaagatgccagcaaagcccatcctccgtacctttttcgtagcaaccgacataaaatatccgcaccgcttcaccgctttttccttcggggattttcaacgtcacttcggcataactgatatcacaatccgcgacacgcgcctgacgcccgcctttctgtctgacctgaactaaccgtgctccagcactctgtaactggctgataaagccataaagtctatcctgactttcctcaatacgccggctttgcatcgaacggataacgaaacgttgtttttggctcgttttataacgcagatattcgatgatatcggcttcacggtcacagacagaaatcacgttggccatctgctcccctaaccggctgtcggcggtttgtgaggcccgttcccacttataactctctttcccttcataagggcgtgtgtcgcgttatcggcttttgccataatcactgacatctcggcaccagcgctgttgctctatcaaccccacgacctgttgttcttcaggtgcaaataacaacaccgagtgtgcctgcatgccccgggattttttcttcgaggtggtataaccgagttcatcggcgaccgacgcatgggaaaatgacagggttgtcgtgtcttccagcgctaacaggcaatgataacgttgagcgtgagcgacggtggcggtaaatccggcttcggcgatggcctgaggcgcaatggcggaatttcgggtcagtcggtaggccgcttcaacatcggcaggagagtcaagagcttgcacgagcgattgtcctatatggttagccaacgaacaggccactttcaccaggcggttggtacggcgtttatcacctaattccgcgtgttgaaacgtgtcacttgcccattgttcggcgcaggttgaaaacataaagattacctcaagtcgtgttttttattgggatcaatctatgaggtaaaagttcaataacgagggggggcgggttaaaatatttgtgtaggaaagacaggtagatacggggataaaccgccattgggcattaaacccccgacaaaggtcacgtgttccccgtagatacggggataaaccgagtgccttttgaattggtataagcgatctacagtgttctccgtaggtacggggataaaccgtagccgacaaaattcattgacctgcgtttcaggggttctgtcgcattaacggaacatcaggtaagctccctattttttagcgaatccagaacgatgtccctgatccgaaatgtattcaaacgcctgcattatcctgttgatatcatcgctcagtgcgttcgcgggtatctggcctacgcgctgagcctgcgtaatttgaaagaaattatggctgagtgcggggttaccgttgatcatcccacgctctctcgttgggttcatcgctgggttccgttgatcgttaaacgttatcggcggagcaagcccgaagttgagcgtcggtggcgaatggatgaaacttatatcaaaatcaaaggacaatggcgttacctctaccgtgctgtagactcagacggtaatacagttgaattttttctgacagctcatcgggataaaaaagcggcattgcgtttcttcaaaaaggcgatgcgtcaacatggacaacctgacggggtaactcttgataaaagcggtgccaataaagcggcgttgggcgaaataaacaaggaaaaaccgaaaaataagcagattaatgtcaggcagagtaagtaccttaataacctgattgaacaggatcatcgcaacgtcaaacggcgaacacgtcctatgctgggattcaaaaactttagggggactcagaccctgttagccgggattgaacgggtcagtatgttgcgtaaatgacaatacccacaagaaccggaatacccaatttcacccgccgctttttcctatcaactcactgcataaaaatcacttaagatgattttgctcgcgatctctctgttaatgcgacagaaccgtccccacagcataaaggctttaatcctttatgccgcaaaaagggacatttctatattggcgaaaagtgacattactacttagtacctacaaattagattcacctaagacagcttgatgttaaaaagccagtattttactggctttttcgtactagggcttagtccaatcttctattcttaatccatcaactctttcaaactctcttgtattatttgttactacaataagtcctttacttctggcatgagccgctatgtgtaagtcgttatcaccaatacgttttccttttttttcaagaatagcccttatatcaccgtagtgaaatgctgcttgttcgtcataaggtaaaacggtcaaacgtgatacaaagtcattaacagtggctagatttttagtgggattcatgcttttttcagctccgaaaattaactctgcgagcgttattgcagaaatagcaagttgattagtgtgttgattaaatttaggtaatagagattctggtttacgtttaatcgtaaatattacgatatttgtatctaataaatatttaatcatcgaaggattctctttcgcttgttatctgatcagctctgtttggcaaaaaatcatctgttacagactgatctgataagaaaaagctatcccatgcgttttggacgggagagattatacgttcctttccgctaactcgaacaataacctctttaacgttatcagggaaacgtgtatctgccggtaagcgaacattttgagttcgattactcataaagactttaccttgctggatcatagtgtttatccttttaaatttctgccatatagcataagtatatagcatttttaaagatacacacaagacccattataatggaatgatcgccccttccctgaaccagcggtaggatgttgttgataacactaccagcggaggcgcgatatgactgttataacgattggcatcgatttggcaaaaaacgtgttccagatccacggggttgacaacaagataaagaggataaagtgcgtcaggcacgggaagcacaacaagataggtgagtacagggataaaccgacatgcactatctctttccctgctggcatattgtattcctcgtgagtacgggataccgccgaaaaacaggtaagtcctcaataagctatatttaccaatttattttcgtggggttctacatctgtttagaaaaaaaataatacaatcttgtcagtaatcaatcactattatatgttctctgccaatacggagataaatcgttgttattttcactttgattgattatcagttatcagtgttccccgtaagtacggggataaatgaccgattagatattacaaattatgatttttgcttgaacaatcttgaaaataataaagtttttttctttttgatttaaataacatgattaattgtctgtaaaaaacaaaccagctttttacaaaagctaccatacagaaaaatctctataggaagtaaaccaatgaaacattatccactcaaactcaaacgagctatccaaaaaaaattactcccccctataacctaagcgtcagtttgttagctaaaacagaaggtatttctaaaactactctgaacaggtggcgtaactaagctcttgttttgaatggtaaaaatattttagaacagcttcagcaggaaaataagaaaacaaagaatccacatttaaaacataactctataaacttttcacatttatcccttcatatagttctaaatgtgagcgtcattccataatctaattgaattaataaaaacaacacaaaaaaggtggtgaatttttctattacttgattaatataaaatatctgttcatccactgtccaaaactcttttttctcaaatattacaatcaggaaactcagttgactatcaatacgacaacagaaacgacttactggaaccctatggtgccggaactcacagtgacaaattttcctgtgtccctggatttctatgtacaaatattaggattcaacataatgatacggcgaaaagatcccgattttgcctatcttcatttagggaaagctcaactgatgctggaaacgtttcacgaaactggctggaatacggcagagcttaataagccgctgggacgtggcattaatttgcaaatagaagtagatgatatcaactccattcttaatcgcctgcaaatcaacaagataaaactttaccgtccattgaaggataataactacgccacaggcgatacccacatctgtcagagagaatttctcgttcaagatcctgatggttatttgctaaggttcagtcaatacatagagtaaaaataaagtcttcctcaattaatgaataaaactcagttaaaactttatttcatttcggaaacctatgcctacgttaataaataattttggttatatcatccgatattggggcaaggcccagaaaaatatctattctgatgccgattatcaccttctggcttatcactgtctggcttatcactgtctggatgttgcggcagttggcaaatatctactggctccccacaaaaaaattaccgccgatattgcggattttctggaattatcaaaagaagaattacaaaacctatttgtattttttttgcttctgcatgatatcggtaaattttcttccgcattccagcaattatattccccagaacaacacactgaactactgaaacctcagcattgcaaaccctacgatggcaaacattatcgccatgatcgtttagggctgtttttctggaaacagatccaggacgatgtgctgtttgctttggtgggagacaacaacctgcaacgcagagataaagatcgggcgcaggatacgttgatggtcttaatgcagtgtatgctcggtcatcacggcaaaccgattgatgatagcgactggcaggcaattggcgattttaccgaagcccaaaatataactgatgcaaaagccttcacaaatgatctcattgccctattccaacctcacctgtcattggaaaaattactttccaaagaatggaaagataacctgaagcaagtaagttggcagttggctggcatcgttgtcatggccgactggataggctctgacagtgcacgctttcgctatcaaaccagctccatgccattggcagaatactggcaaaccgccgaacaacaggcgcaaattgccctgaatgctattgatatgcaatacacaccagccatatcgccgtataaatctatccagcattattatggtttttcaccaactccattacagcaatgggcagaaaaagtaccgattgatgattctccccagcttttcattctggaagatgtgaccggtgccggaaaaaccgaagccgctctcactttaacccatcgcttgatgcaggccggagtcgcagaaggtttctattttggcctgccgacgatggcaacatctaacgccatgtttagccgcgtcgccaaacactatcgtgagatgttcaataccagcggcaagccaccgagcatcgttctggcacatggcgccagtaagatgaacgatgcattcaatgacatcatcctgacctctgaaaacagcgataacgactacaccaaagatgagatcacagcgacagcacaatgccatcaatggctggcggactcgcgcaaaaaagcactactggcacccgttggcgtagggactatcgatcaggcgctgcttgccgtcttgccccgaaaatatcagtcgctgcgtttgattggcttgaatcgtaaaatcctgatttttgatgaagtccatgctgcggatgaatacatgtttgccctgctggaaaatctgctgaacctgcatcttcatcaagggggatcggtgatattacttactgccacactttccctgaaacaacgccagaaactggcggatatctggctatcttccgcaggccaaacaccgcagaaactgcggcaaacggcctttccgttggcaaccaaaattacgctcactcctgaaaatccgattattgaacaacccctgcacagccgctcagatgtcagccgtgaagtcatcgtgaaaacactggactctctggatgcttgtgtgcaaaccgcccttaacgccgccaaagaagggcaatgcgtggtttgggtacgcaactccgttgatgatgctttacacgctttccgattgattcagtcacagatgaataatccagaagattgcctgttgtttcacagccgctttattttgcacgatcgcaagaagatcgaagatcttgtactggagatatttggcaaaaatagcacccaactgcatcggcaaggcaagattctgattaccacccaagtttttcaggaaagtctggatgctgatgctgacgagatgattgccgatatctgcccaatcgatgatttgatccagcggacaggccgcctgcaccgccatacccgcaatgctgaagggaagtatcagcaaggtattaacgatggtcgtcctgcccctgtgttgtatctccacgccccaaaatgggacgatcaaccacaagcagactggctgagtaaagattttcgcaatacccaatatgtttatcgctcaccggggcgcctgtggctggggttgcgtgaactgcggcgattgggcgccatcagaatgcctgccgaagccagaactttaatcgaagcggtttacagtgacgatgcgtatgaacacatacctgacaccttaagacataaggaaaatgaatttattggagaaggccacagcaaagaggccaaagcagaatcacagaccttgcgatggaaacatggatattgcaatcacagtgccagcggatggtatgacgatgacagcgatatcaacacgcgattcagtgatatcgaaacggttgaggttctgcttgttaaactgactgacaaaggtgcattaataccgtgggcgaacgagggaaaatttgccgttcaactcagtaccatcaggctaccaaaaaacaaatttgccgataagttactggcggttccagaatcgttttctcatgctgtagaacagctaaagagccaattcaaatctgctaaatacctgcaaatctggctgcccgaactcgaccccaatttcagttacgaccctactatcggtttttatgaaatccaccagcaggaggcatgatgaaccttattaaagacgcatggctgacctttaaaatgcgggatggtagtcaaaagaaactaccactggcggctatccgagatcccaacgtcatggattttgccctgccacgggcagactttcagggcgcggcctatcagttagccatcggcttgctgcaaacagtgtttgctcccgtagataagtttcaatggcatgatttttatgagactcccccaacacaagcagatttacagacagcctttgaccgcgtggaacatgcctttaatctgtcaggtaacgggccgctatttatgcaggattttgattcgctggagagcgtcaaatcaacgacgatttctggattactcattgaagcgcctggagcgaatacgctcaaacttaacaccgaccattttattaaacgcggccaatgtgaaatcgtctcgcctgaaatggcggctatcgcactttttaccttacagattaatgcgcctgccggtggtgtcgggcatcgtgtcggcttgcggggcggtggccctctgaccactctggttcaaccccaaacgctggataccccactctggcacaaactctggcttaatatcgtcaatcaagaatactgcggctatcccgaagcagacctccacagccccagtgtctttccgtggttaggcaaaaccaaactcagccagcccgccggtacggaaatttacgcttctgatgttcatgaactctatatgtattgggcgatgccacacggcgtatccgtctgcagatcgacgataaacccgctatttgccaactgaccggacaacccaccgaacaatctgttacccgctatcgaacccaaaactatggcaacaactatgccggaaattggcaacacccactcacgccttataaatggaatccgaaaaaagccaacgacgatcacctttctatcaaagggcaaccgggagggatcacttataaactatggaatagtctggcattttccagaaataacgagggacaaaaagccgctctggtcgtcgatcatttccaccagatttgtgattattttgcagaggaacacagcgcaacaccccggctatgggtctttggctatgatatggacaatatgaaagccagaggctggtattccactacacttcccctgttttccatcgccgttgaaaaacaggatgtcattttccggcgagccagaaatttacagaccctttctgctaatgcactgagccaatgccgttcccaaatcaaaagtggttggttcaatcgcccaaatgatgtgaaaggcgatatgtcatttattgatgctgcgttctatcaacgtactcaaacggctttttttaaagcgatacaacagattatcagcagccagcaagcatcttcttatctctcgccagaagaggccaaaagctggctctaccaactgagaaatacctgtttcgatctgtttgatgaatatgtgctgtcagaaagcgtcgatccgaaaacgctgccgaaaaaagtcaaagcaaggcattttttgactcagtggttatttggtgccaaagagatcaaatcatttatgactgaataccaaatcgaacgccaacagaaagaggtgatcaatgaataagttgagcgaaagtaccttgctgcgctggtgggaaagcatgtttctatcaccatcagaactgaaagctaaaggcagataccccgctccaacggtgtataaagcgcagttaaaacgctgccagaatatcgacgcggccatgttaaccggaggctttcgcaccttgtggctgagtttacaagaaagaaacgctgaaaccgtcgatgaaaaaaccatcataaaatgggcaatgattgccatgacgggcgtgcatgtgaaacacaatgtaaccacaacactggcaaccgcagccggcaccaaaacagaaaatgataaacctgtcgtcagtgcactccgcttcgcccaattgcagggcgccaaaacccccgacgaatttgttacccgcttacgacgcaccttgcagctcattgatggaaaagtttccatgctggatctggcaaaagatattgagcaatgggctcacgaatgccaccagcaaagaccccgtcgagcgaatcagcgtctcagcgtgcaatgggcgctggagtattacaaagcagcaaaataatcacttttaacctttgaggtatcctaaatgagccaatttattcaattacatctgctaacctcctacccgcctgccaacctgaaccgtgatgatacagggcgccctaaaacagccagaatggggggttttgatcgattaagaatcagctcccaaagcctgaaacgccactggcgagtctcagatctgtttcaatcagcacttgcgggacaccttggatttcggacaaaacgctttggcctcgaaatttatcaacaattgatcgaagcggacgttaaagaaaagcaggcgacagagtgtgcttctgccattgcgggtgtatttggcaaaaataaaaaagacacgccactggaaatagaacaactggcccatatcagccctacagaaaaagccgccacaatctccctggcaaaacaactggccaacgaaaatcgggcgccaaccaaggaagagttaagtctgttgagcaaagagagaatggctgtggatatcgccctgtttggccgtatgctcgcttccagccccgcctataatattgaggccgcttgtcaggttgcccatgccatcagcgtacatgatgtaatgattgaagatgactattttaccgcggtggatgatctgaacgacggcaaaagtgacacaggttcagcacacatcggagaaaacggatttgcagcggccctgttctacagctatatctgtatcaacaaaaccctgctgatggaaaatctggcagacaaccaaatcctggtcaatcaagccattgctgccctgaccgaagccgccgtcaaaatctccccttccggcaagcaaaacagttttggctcccgcgcctatgccagttatgttctggctgaaaaaggggaatatcagccccgctccttgtcggtcgcatttttgaaacccattaacgatgaagagcaggctgcgtctgccattagagcattggaagaacaggtcgaaaacttcgataacgtttatggtgactgtgctgacgcccgccatagtatcaataccctcaccggaaaaggcagttttgccgaactgattaaattcatcacgaattaaaaggaggccggaatgcaaacctatttggtttttcgattatatggtgtgctggccagttggggcgtagaagccgtcggtgaaagccgccccaccagcctgtatccgactcgttcagcgattttggggctattgggcgcagcactgggcatccggcgtgatgatgaaatgcgccttgccgagttacagcaaagtgtcaacatcgccatcaaacaaatcgtggccagttcattgatgagggattatcacacgagtcaagtcccctcccaaaacaacaaacagcaacacctcacccgtaaaagtgagttgggtgaatctgaactgaatacggttttatcctcacgggattaccgcagtgatgggctgtggatcatcgcaatttcactgaccgaccaagcccatctgacgctggcaaccttgcgtgatgcgctgttaaaaccggttttcaccttaagccttgggcgcaaatcctgccctctgtgcattcctatgatgccgcaaataacccgatctccctgtttgaaggcggctctggatacggaatttccgcctttaacgcagtcggagaaagccgatcactattggctgggcgacaacggtatcgtgagctatttctgggaaggggataaaaacgagattgagatccctgatgtggcggtattgaccagccaattgtgggacgaaccgctttcacgaacccgctggcagttcacccaacgtactatgcaccaattatcactgatggagaaggcacatgtacctgtctaaagtcaccttacgaccttctgcctatcgggaacagtttttgtcaaaaatggcgaaaaacagtgtttattcttcccaccagctattgtggcaactgtttacggaacaggcagagcgcaattttctgttcagggaagatatgagcatcaacggtacacctgagttcttcgtactgtcccatacagcgccaacacccaactcggcgatgttccagattcagagcaaggcatttaccccgcaattacgcagcgggcagaaactggcgtttaagctccggctaaatcccaccatctgcatcacagataaggattccggcaaacagcggcgtcatgatgtactgatgaatgccaaacgtcaggcacagttggcgggtgttagcactgacgaaatccagccgctgatgatgcaggctgtacaggcatggatacaggatgaaaaacgactgactaactggggtattcagtttgatttcgatcctgatgttgaacgctatacccaacatcgctgtcgcaagccttccggccagaaagtggcattttcgagcgttgattttcagggcgtgctcaccctttcagatcatgaactttttctggcgcaatacgctaagggctttggtcgggcgaaatcctttggctgtgggatgatgctgataaggactctgtaagtgttccccgtaggtatttaaactacccttctgaaatttcgtctgcgaaatgtttgagtgttctccatgactcagactcatcaggacaaaattgtttttactaaagtcactagccgaaacattcaactttagttactcatttcccagcattattcgttaacgggcttaacataagctatgataatctactgcgtccttcattttcctttgagtttattatgaccttaactaacttcagcaaattgttagccgctacactttgcctcgcgacttcatacagccatgcagatagtgaacgcccacttttttcattaacgatggcagagtctggtgttcagaagacaaatagcgatggtagtttatctcattctacaaaatcagaatctcgcattctgccaatttggggtgatgaagcgcgagctaaaggctacgatctgcctgagccatttggcgtaagttatggttatatgaatctgcgccaagatatcattatagacagcattaaatttcaatttaccaatccattaattgaagagcgttggaaagaccaaattattgttaatgcgggtgatacccgggaaagaaatgaaacccatatgctgaaactggatacatgggttttacccttcttaaatgtatatggtgtctatggaacaaccaaaggtaaatcaaaaacaaatttagataacattgtcgcttttggcgatgatgaaacctatagaaatattccttttgaactgagttttaaagggaaaacttatggtggtggagcaactttcgctggtggttataaccaattttttgccacgttagatgcaaattatacccgaaccaatttggatattttagacggtgatatttccgccttcgttgttactccacgcgttggttatgagtttgtttttgaaccgctgtttactggtcaaggaaacgccaaagttcaggtgtgggtaggtgccatgtaccaagatatcacccagcgctttaaaggtgatgtcagtaaactcaatttaccctccgaaatatcagagttatttggcatggttcaaagccaaaccgatatcaaattcgacgtcgaacagcaccttgcacataaatggaataacaccgtgggtgcgcgtttcgaaatcactcgtaacttcaatatcctatctgaagtgggtttcggcaaccgaaacagcctctttgtttccggtgagtttcgtttctaatgttccgacgcatgacaatcaagaggctggtgatatccagccttcttatttttaccgcatcatcagcacaggctgatatcttgcccgatcggcaaaaaatcgatggttggctcagcgaattaggcggcagtaatcaattcgatgccagcaagaaggttgactggggcgtgctgcccggccctttttacacccctgaaatgggaatgggcattggggtcgctgtagtcgggctttaccgtcccgataactcagaccacaccagccagacctcctcactgggtctcagcggttttggttcatctaccggcgcatttggcctgaattttaccaattataattttctggctcgtgatcagtggcggttatttgtttccgggacgctaaataacacgccgacttactattggggcaagggttatgacgccggtaaaaataatggcaataaagaaaaatatcgagctcaggaatttgatattcgccctcgcctgctctatcgcgtgacagatgctatgtatatgggattaggctggcatttctcatccctcaacgccagtgatccggatatcggtgccgcaaaatatttcgcgcagtccgtcggcggacgctccgtcatcagttccggtgtaagtgcatacttcagttatgacacgcgggatttcctgcctaatgcaaagcacgggcaagcatttgaaatcgtttatacccacttttccccagaattagggggagataatcgtttcaataccacacagttacagttttcgacctatcaccagctatccgaaaaatccgtgctggctttcgataactatgcccgtttcagctctggcgatgtgccgtggaatcaattatccctgctgggcagtagtcaacggatgcgcgggtactatgaagggcgctatcgcgataccaatatcttcacatcacaattagaattaagacataaacttgactggcgccacggtattgtcggctggataggcacaggcacattaagtgattccccttcaaagctaggtgcaaagcactggcttccttctattggtgtgggctatcgtttcgagtttaagccacgcatgaatgtcagattagattttggtgttggtaaagacagcactggattctactttcaggtaggggaagcattttgaagtcattgatgacgctattattcagcttcctgctcatggcatgtcagggtaaatctgctcccgtcatgcctgtagagcctgtactcgtcagtgatactcaagaacagccagagctcgactggccagcgttgacccctattgaaccacctgaaggcttaagagcctgctgcgcatttggttacgatcttaaaaccgaggtggtgggggttcccgttcctttctatgatatcgacaatatcgtggaggccgagaaactgggagaacatcactataacgacagtgctctgggtgccagtgccgctttattggggataagcaatgaaaaaatcggtctgttatatacccagaaaggcgggtttattgatatctcccatgtgagagataccgcagactatacgctgtatctctttagccagatttatgctcacctgggtcaggagcgggaattaagcctaagtaatgagcttgcggcgcgtaaaattcacttttttgcctttactccgccggtagatctcgttgagcgctacaccttaagcgcttatttagcggcaaaactggcatttcagttggcggcttggcacgaaatcgcccaatggtatggctatcaatcagtcccagggttccccgagggcatttccgcgttttccccggaagacctctattccaatctcttgggagcaaggctggctctgaccctgatcctgcaaggtcatgcttcttcggtgactcaatttactacctcaatggcagccatattgccttctgctttgcataaactcgaaccttattccaaatcagacacaaaaaagatgtttaatcagatcgacgggctatggtggaatagtcatgaacgtattccgcaaaaatttttagtcctgcgcaggaattatgaaacccaagacaatcgttatccattaatgccttcaggcaaagaaaagtttgcgctgcgtctgtccctgcctgatgaatataagccgttttcgctggataaattggctgagctacagttatggccaaccgaacagatgaaaaacttacctgttcccaattcctattggacaatgaaagactttaacatgctggcagaacatgcccagcatgaagatgcgcgacagttgttattgagtagcaaataaataccgtagccagtgactcggcaaagcctttcgattaaattcgcaaggagatagcaccactatctccttactctttcccgaatctccccaacgccctgcgcatcggcgtatgccgcttaatcagttcctgcaaaacctctttcagtaactgacttttaccgcttcccagcggctccagtatacttttctcatgggattctgcttctgccagtaatccgaccaccacttgtcggccgctgtcggtaagatgcactaacgtgatacggcgatctccaccaccattggaaaaacgagtgacatgcccctgcaattcaagacgctgcaatactcgggtaattgtcggttgtttactgactgttttttgcgccagcaggctaataccaatcgggccacttccagccagcgccgataaaacacgccactccagcacggacaacccccgtgcctcaacgatgtcatgaaactcagaagaaaccagcatccatgcttgcccaagcaaagcaggcaagtaattatcaacaaacacttttgaatctggcatagtttcaacaacctttctatttcgggaagttttgtcttccaattctaaaaggttcatccgtgaaaaacacgctcacaatagtcaccccatcaatgttttcctgataaaagtgagccaaatctcggaacgtatgtatgcagcccaagttgtttcaatatcatgcaggctatcgtaatagatggggagataacgagcgtgagacgtttcagcgccggatacaaagcccgttatggtcagatgccgagtgaacgtttatggcggagatgattttaatttatatgacaaaatttaacgcagcccatcgttatcgcgtgggctacgttagacataacattaatctcattgcagcgtggcagggaagccatgttttttagctccccaagcgattatcaatcccaccacaagcaatccaagcaaagtccaagggaagatatgaacaccctgagtgtctagcaatatgcctcccaacataccgccagcagctatcgataaattccagacggtaaccaagattgattgagcgacatctgcaccagaacccgcagcatccgcagaggccgtctgcaatagcgcggctgctccgccaaaagttagcccccatatcgccatagagatataaattacagcaggcaaaatacccgcaagccccaatgccagtgcgaccaaagcaaataatccgatgcttatcaaaacaagcgaccgcaaatatttatcgatcaataccccaaccaaccatatgccaaggactgaagaagccccgaagattagcaaaattatgtcaactcgatgggaaagacccgcaggagcaagaaatggcatgatgtaggtataaagaatactatgtgccagcacccagaaaataagtaccgttaatactggtcgaacacctggagtggcaaataccgatcttatcgataaacgtttttctgatgattgtccgggataatctggcacccgtaaacgaatccaaaccatgaccgctaaagtcaacaatgagagtaggccaaacgtcatgcgccacccaatcagtgagcctagaaatgcccctaaaggaacgcctaatgaaagtgccagtggtgctcctaccccggcaatggcaagcgctctcccttttagtggttctgatgccatccggcgcgcataacccgccaacataccccaaatcaaacctccggccatccctgcaaataaccgggcaatcagcgcaaaagtataattagatgtcaatatagtcagtgtattaaaaacaaacaacgcgcctaaaactaccaataaaagcggacgacgtcgccagctttgagttgccgtcgttaatgggatagccgcaatcacagagccaatggcgtacaacgtgacaaattgtcctgccatcgattccgaaatattcaatcccatactaatttgcgccaacattcccgcagggacagtttctgtcatcagcgccaaaaagcccgtcattgccagtgcaagcaatgacgctaatggcaaagcatttgtttcacccgtgtgacttgtggttgatctcacttaactgccctcctgtaaaattctttatctgaaaatacataagagcgagttaaattatacgcaccctatgaggttcacagaatatgtggattgctagatcggctcataggtagacagtatgaaggcgcatattagtattaaaaataggctatagttcaaaatatatatgacaaatatgtcatcaataggaaaacgagtaatggataactttagcgtccttgaagtgtttgttcgagtcagtgaagtacggagtttcacggcagcaggcaatcaactcggcgtgtcatcctccgctataagcaaggcaataagtcgcctcgaagaaaagctacgcgtacgacttttccaccgttccacacgcacagtgaccttaactccagaaggtacactttttctcaaacgctgccgccgcattctgaatgaaatagaagccgcagaaaatgaactttcccagtcacaatctgtaccgtatgggaagttaaaagttagtatgccatcaattggcgtactctttatgcccaagtttgccgagttcagtcagcagtacccagaaattgaattagaaatagacagcactgacggcttagttgacttaattgaagaaggattcgatgccgtaatacgcaccggagaacctgctgattcacgattaatggcgcgtgtactaggctcttacaaaagagttatcgtcggttctcccacctactttcaaaaatttgaaatacctaaaaaaccagaagaactgattaatcatttctgcatgatgtatcgttataagagcacaggcaagctggatatttggccaataagtcaagataacccaactttacagctagaatggcctaccagaatggtaactaacacacttgaccctctcgtgtcttttgcagaaaatagtcttggaattacttgtattcctgatttagccatcagagaacagttgaaaacaggaaagctgataacaattctgaatgatttcaataatgacataacgacatgcaggatactttggccttcaagcaaatatttatctcccaagttaagagtatttatcaatttcatggtcgaaaatctatttaagaatgaatgaagtatgagtgtctagtattcaatatgatactggacactcaattaatttcaatactaaataattccaagggttccgcattgagataataaactcttcaaaggaagatttgaattagataaaaggagcctatccaaactaattatatgatcagccattctctttaaatcagcactttcaatatgtgatgaattagatatccaacgaaaagcccccttaaccggatcaatttgcattgtcagagaagcattgtttttttcatataattgagaggctgctggtttaacttctgagtttatgaaatctataatgctaattctaacattacagatatactttgaatacacagattcagttgagcgtaattgtggatatcgaaaaattatatctttatggaaagttttaaatttattaagtatagaacgctcaactgatatagaactatataaattcaatgcagagcaattaaagtcaatattaaattcaaaaggaactgaagctgaaaaaaagacagagtaatctataacctcatgtttaggcagttcagttacacaatctaaatgaaaatattgaacatcattaaccaatgctaaatatacggcgaatgctcccaatatattaaccaatctttcttcacttgtaacattttcaatgtcaatataaaaattccagttataatatatttcaaaaatacaatctaagtcatgatacagagtgtcaaatttgaaatttaatggtctacatgattctaaacgattaacccaaaatgattcatatggcgctaactcctcatgttcctgagttaaatcttctaaatcagaattattaatgattggtaatgaatcaccaacgcttatgcaaagcatatcagccaaaaaatctgcccgcaaatcttccccggtcaattgaataaattctattctgatatctgttgttccggtagttacaatccagaaattttgtgctatatccactaaaatacctgcctgcttatgtgttgagacagaaagtacttcaagtgttttcactattcctataatatttatcaaataaactttcggaacacataacggattgcgataacgctcaccgaaagacaaaccacgtactaaagctgacagctcttcggccgaatgttcccactgtaaacatgctccagcatatggacgtttccgactagaaaaaaaacttctctctgataaattttgcttcacatattctatggttttccctcctttaataagggatattaattttttaaatccttcaaatgccgcattatagcatttcatatttaatgaaagagctgtgtcagaacgattaatttctacattttgttgaactgctatatctcccgcgtcaaccacggtagcaattcgatgccaagtaactgcatacttatcctccatcgcaaaaagagcccatgaagtcgcatgagttcctgcatatttaggtaacggagcatcatgataattaaatgcacctaatttaatattatctaatagtgcagaggttaaaatgattggatttgatatagataacagccattcaacagagttgttagatactaaagattctaaatcctgaatagtattgatacattttaaaccttcttttttagcccatgaaagaaatactgaatctaaaggcataactacctcaagatggatacctatagaaagtaagaattgacagcatctaacagctaaagtaccttgaccaataattacaaaagtgtaattttcacttgactccattgttttcataataattttctcatattagaaccaatttcacataattcatataaaaaatactactaagcattattctaaaatataaaaattacatccaagtaatcaacatacgcatttttgacagtaactcattaatccctggctcttttagtaactcaaaatgaggtacattaatcttgacaacatcaggaatattaataaaacaattactattggtttcaaaataagacaattgatcgctcttagcgctaaatatttttacaggggcagtaattaatctatcatgaaaaatactttccgattccgaacgtaagctttcagaggtagttatgacaactctagaaattcttttaattagatcaaggcttaatcctgaatgtcttttactaataaaacttgcgaaatcatcctcatcatttacatagtctaaacattccaataaatcttgatcatctgaacttcttgagaaaactgaaaatagcagagagaccaaacttttattctcatagccactagatttatctgatgactggagttgtaaagaatgtcctttagtcatacctggagcaatcagtacaagttcttcaaccttttcccccaactgctcaagttgataagcagcttcaaaagctaaaatagttccaaatgagtatccccaaaggacataagggccttgtggttgtttatttcttattgcagtaatatcagcatgaactaatttttggatagaaccatatggtcgttcatcttcatttagtccaaacgcctgtattccataaaagggacgaactttgccaattttttcagcaagtagtctaaggctcataggatatccacctaatccaggccaacaaaaaattgatgataacgccccatgtggctgtagagaaaccaatctctcagaatatttattacgatttacatcaactaaacaagccagtttttcaattgtcgacgcttcaaataaaatatgaagtggcaaattagaacctagtttattatttattgattgtataatatctaccgcactcaatgaatcaccaccaagagaaaagaagtcatcacaaacagaaatactattttttttcaggcattccatccatatactttgtatcactctctcgtttatagattttggttcatatttttctttaaaattctccttgccaaaaatattttcaattttataaaagtcaatttttcctgttattgttaaaggcataacatcaacaaaaaagaataaagtaggaatcatgtaatcagggatacgtctggccaactctttttttagaatagaaactaactcttgatgatcgtgattttcttttaatatcactccttctgtactgagttcaacacatgccatcagaatagattggctaacatcatgatatttattcattacagcagcaatattaattaaaggtaatgactctaattctatttttatttcttctaattcaactctcatacctctaatttttatttgagtatcttttcttccaatgaaataaaatgaaccatccatgttttgataagcaagatctcccgttttataggacataataggcgtattagatcccgttgggatgaaagaaaagaaatgtttattagtcaaatcttcctgattaaaatatcctcgtgaaatttgaatgcctgatatatagagttcaccagaattaccactggaaacagatttaccgttttcatctaaaatatgaaactcagtattatcaaccggtctaccaattgatactccttcatgatgttctttttttattccaattgaaacattatagaatgatgcattacaagtgaattctgtcggaccatagacattaatcaattcgcaattaggtaatatatccaagcattgcagcgctaatttctttgttaaactttctccaccacaaagaatatgtgaaagtgatgaacatttcgcaaacttatgcctattaaccagcgattgcaacaaagtcggtacacactgcaacaaagagacattattttctataatatcatctactaacttcgaaatatttttgtttatactaaaatcactaataattaactgagtaccacaacaaacagatagcatttcccattgagcggcatcgaaactaatagatgttttatgtattatttttttatccctgcttaaaaacccttttttattcaaccatagcatttggttaacgattgaacggtgctctatcattactcctttgggttttccagtactacctgatgtatacacaatataagcaaggttttctggttgtagctcccttggtttaggagcagattttgtcttcgcactcattttcacataatcaatgacatcactaatcgttattaaagtaatatcactactaataatatctaaaattttaaattttaccttttcctgaacaaatatatatttcattgaagaattttctatcatatacttcaaccgctcaggtgggtaatctggtgccaatgccaagtaggcagctcccgaaaaaataattccccataccccaattaattgttctaatgatggttcaacaaaaaggcctatacattcatctgtagaacaattcagatagcgtaaataatttgcaacatgcaaactaagatgtgccaattgccagaagcagagtttatcatcaccatccacaatagcgacattatccggtatatggcgtacacttgataaaaaaaggcctggcaaacattgatcaatggcatattcaaaacgttcttcttgaccactagtagaccaagatatacttatcttatcataagataatgaattttttagttccactaattctcgaatatctaattcaaatccctttagattcaatagcctttcccaagatttattttgtgttactgaatgcatatcctatacctcgttacaattaaaaaattcataatgaactaagatatgaaatcgaaatatcctgatgctgtataatcttttcctagttttttaaacctttcatcaggtaaatgatatccattatttaaatatttatttgcaaaataaaaagaacttttatcgttcaaaccaatactttctagcatcctgagcacctctttaggaatttgtagatcgatgctattgacataatcaattaatatattctttacaccactgccatctggcattctaattttaggcctgtcaataatgtaatctggcagaaaatctcggaacgcttctctaagtatatatttttcaactccattatttatcttcaatgattcatgaaggcttagtgcataacgtaccacttgattattcataaagggtactcttgcttctacagagttacgcatactagcgcgatcaacacgctgcaaatcagtacgatgtaaattatttaatctataaagtgaaagctcatcaataaaaggatatgttttgaataaatcatagccgcaaaaaatctcgtcacttccttctccacataaagcgactttaaaaccaagcttattagcaatcaaataaccaaaatttgctataatagagtctactgagtctattttttcgaagaattctccataatatactgcgctatcaatatcatcaattaaatcttgctctgtaaatgtatatattatctgacgtattttattttcttcacaaaatctctttgatattttgatatcgtctgagccaggtaaaccaaacgaaattgcagtaacattagaatgatatttatttgctaaagccaatataatagcactgtctattccaccactaaacataacagcaaccggcagatcagtgtcaacttgagactcaaccgcctcttccatcaacttacgaactttttgttttgctacaagataacaatccttacttttttctatagatttatcatagcgagtatacttataaagctcattgccatcataaagactcccaggctcaagtgtcttaacttcaacatcaagttctagaaaagctttcatctctgatgccacataccaaacatcattcttttttgcatagtaaagaggctttatacccacgtgatctctaccaatcagaaactttgattttttattatcatatatgacaaatgcaaacattccatctagcatatttacaaattctaaatcatattcaatatatgcctttaatattacctctgcatctccatatcctttaaattcgtgtcctcttttgataagtttttcacgtatttttttataattgaatatttgcccattaaggatgacatgaatatccctttcttcgtctgaaacaggttgagtcgcggtttctctctcgacaattgccaagcgatttgtggcaatcccaaagtattttttaactaggtgttcattaaaacgagataaatctcctcgatgtttcatcctttctatcatagagacaagcttactattcaattgttcaattaaaatttcttttgtcgtaaaaatggctgcaattccacacataaaatattttcctttactaaaataggattattttcatttagccagttcattaactttcgcacctaaggaacgaatttcagaaaaatattctgggtaagtttgccctacatgaaatggttcttttatcagaacaggctcactacaatgaaggccgattgttgtgaggcccataataagtccatgatcgtaatgtccatctagaaccaccccgcctttatatcctttgggattcccatggatgatgagttgatcatgtttttcatctgattttacccctagttttgataattcttttctaaaatcagatatccgatcagattctttataacggatatgctcaatgttataaaaaatacttgtaccagaggctaatgaagctctagccgctaacgctggaactgcatcaggagccaaagaaccgtcaaaatctaaaggacgaatttctgtattccctttaattattatcgtttcattcccaataaattcgatattagttcccgtatcgattaaatattgaattacagcaccatttcccagttcttcttcgaagaaaccattcagttgaacttctgattcgagggagccacaaagcgcaaggattgcagcagtgctagctggatcagaacctactgtaaaatcacttgcctgcaatccacatcgaccatgtacaaaaaattcacgaaaatcactatcatattcgattctaatacccgctttcttaaggttattaattgttgtatgaaccattgatggagctgttattttgtcgactacctttatagttaagtcattatccatcactgctccaagatatagtaatccacttaaaaattgtgagctttttctacaagatacttctgtataatcatttaactttctatcagacttaattctgataggaagtcgatgctcttctcccaatgctctacattgaacattcaacatacagagcgcattaaccatttctgtttgagaacgaactccaagagaggcgtgatagtcggttatgaattttgtctctggtaagaaacccgctacccccatcaataacctcagtactacccctgagttacctggatttaactctaaaggctggttgatagaactcacgtcaattccatttactatcaaattatctttatcttctttgaaaacagctcccaatcgctcacaattagatttcatcgctatggtattaaaaccagtagcaatatttctgataatactttttccagaagtaatagaagaagttagaagggctcgagttgaggaacttttagaagctggtaaattaagtgtaccctgtaaacgtttcgaataaatcacctcaacaaatttactatctttatcaattcttttagacatttttcaccctcaaagaaataatttaactatttaatatgaacgcctaaattcctcagcgtatcgatataatcgggaaatccatcatttaatttatctatatcgtatattatggattctttttcagcaccgagcgatgcgatgagattagcagcacaaattctatggtcaccataacttttaagttcaactcctccattcaacggtccttttccttcaatatatattgactcaaacattcctaccctatcaaatattagaacactattccctcccattgttcttatattctcattaacaataaatgctcgttgacttttatgattatttattcctcttaccccactaaaaattttatttcctttcaaattagatgaagcagcaattatgtttacggctactgaagggagctctttcaaagaaaattcaccatcccataacctaatcgactgcctgaatattctcaaattattccaagttgaatcatacgtaataattagacctatactttgataaaatttaaataaatcacgttcatttattgtgtcattaaaataataatttcttatcagtacatcactagcaccttttgagcttaatatagaagaggctatatagcttaatgatgtaaaatcagagggtatttttatctcaatatctttaggtatatatttagttactttaaagtgtttttgttcgtatgtaactatgcttcctagaagtaacattgattttatcgtcatatcaatatagcccattttactgccgtccaagactatagggactatcttttgtttgctgaaaggagcaacaaatagagcaaacgtaatgaactgagtgctattcaaaacagtcaatgggttttttatattagtttcactcttagtgattataatcctttcattttcaatacgttcaatatgaatatccaaataattacagaaatcttcgtcaaacacactctctctattaaataaagattcattacattttattactattttttcattatcaatgagagatgctaaagctgcgcacattctgaataacatgcctgaaccacctacatatatctccccattatacgataaatttctacctacaccacgaagtaacagtgttgttccatctttgtgtaatatttttagaccaaattttttcagagcattaatttgattttcagtttctacattccaagatatattaacaattctcgttgtattttcattcagtaaagctagtaataatgcacgctgaatatgaggtttagatgacggtataaaaacttcaccagtcaggccaaaactcggaaaaacagtaaccttgctcatattttccctttttcctaaacaacatttttaaatatttatataatcagagctcgtcactttataacacgctatagctctttaaatgattaatataaatttacaattgtggcgaattatcctacatttaacaatttataaaatatatttaatacgaattattaagtatgtttatccttaagataaatagcttagagttcacaactcttatgactatacagtcacaaatttattttttaccaatctaaagtaattaataaagtaagctaattatattctttctaaaatactatctaatgattttactttcctgagtttttctcatcaagacgataagtggttggaaaaaaaccctttctgtcagcatagttgtcatccccattaacaacactgatagagaaaaaaatgacacgtatttcacccgagcataaatctgccgcgctggctaaattgttaccgccgtacaacatgactgtcgccgcagttgcacagatggaaacatgagtttggtcttttgcccaccacttaaatcagccaccttagtgctgaaatctgcctcttggaaaccgaaactatgcagcactgatacggctttataatccgcatattcatcgaattgttttactttccgggaaatacattcaagtaaggacatctcaagcaatgagtcatcaataaactgagataccgtctctaatctcagcccactgacgtattcaatcaatccctcatcaggtgtttcaatacctgccagtaatttcagtaaatgtgttttacctgttccgttatagcctactaatccaatgcgatcgttttctttgattgtgatggagagctctttaaaaagtagttttgaattaacgctaaagctaattctattacaattaatcagcgtcgacatttatgatgcccttatcgaaaaaccgtgattaaacccactatatatttttacatttagcaatagaatgtgaatttatatatttaaagagagagtaggtcaagcatacaacccactaactcagggtaataatgctatttgataggcattgagattatcacttacttaactaccacctactgaagtaggtgggttagcgcacttcggtgccgacgactgaaagtcgtcgaaccacgcacctcgtaaacgcgcataggtcaaagaattaaagtcaaagtcaccgtctaaagacggtggttttaaacctttcatatggaaaaataaattaataaattaataaattaataactttaataaataataaaccattaaaacagtgagtaaggaataaaaaagcaaagcgtactcaatattaaaatcactccttgcttttatatatatttaatactggattattaatattttaaattaatcatttacttatcattatatttcactgaaaaaactaaaatgaacttcgactaaaattcgatatctaattgatttattttaatatttatttttggcacacaccagtaacctctgttattttgtcaatcagtaataaattttattgtaatttaattagttaacaaaaggataaatcaacgtcatgacattgatgtttttctctatatgaaatattttcatgatgtcctctgattcagaaaagtatcaaactgcttttcccaaatattcaattaaaaggagccattgcatcagtgtagataaaatcgtcgctacttttgattggcagtctctaacgtaaatacgaattcacttaacgatttcaattaattacaggaaatgacaatgaaattagaaactctatccattcatgcgggttattcgccagatcctgccaccaaagcagttgccgttcccatctaccagacaacgtcttacgccttcgatgatacccagcatggggctgatctatttgatttaaaagttgaaggtaacatttactcccgcatgatgaacccaaccaatgatgtgttggaaaagcgcattgcggccttggaaggtggcattggtgcactgtctgttgcttcaggtatggcagccgtcacctatgctatccaaaccattgcccaagcgggagataacatcatttccgtggcaaaactttatggtggaacctataacgtgatggcgcacactttcccaagcatagggattgagacccgtttcgttgatcacaatgatattgcagccatcgaagcattgattgatgagaaaaccaaagcagtgtattgcgaatccatcaccaatcccggtggtcatatcattgatatccaagcaatggcagatgttgcccataaatatggtatcccgctgattgtcgataataccgtcgcaaccccctacttatgccgtccgtttgaacatggtgcagatatcgtcatccactctctgaccaaatacatcggcggtcatggtaccaccatgggcggtattatcgtcgattcaggcaaattcccgtgggcagaacatcaagatcgttttgctattctcagcacaccggatgcgtcgtatcacggaattatctataccgaacattttggtgcagccgcctatatcgcccgctgtcgtgttgggccactgcgcagcactggtgccacactttcggcattcagtgcattcctgatcctgcaagggcttgaaacattagcgcttcgcatggaacgccatactgaaaatgccttgagagtcgcacaatacttgaatgagcatcctcaagtatcttgggttaaatacgccggattgcctgaacacccagagcatgaattggcggtacgttacatgggggggaaaccttcgtctgtgctgtccttcggcatcaaaggagaagaagaagccggcacacgtttcattgatgcactggaactgatcgtgcgtctggtcaacatcggcgatgccaaatctctggcctgccatccggcatcaaccacacaccgccagttaaacgatgaagaaatggtaaaagcgggtgtatcacgagatttgattcgtctttccattggaatagagcacagcgacgatattattgccgatctttcacaagcgttagatgctgcaaaatagtcattaatttattattcaaataaataataaaacaccggtatcgacagatgttgataccgatgagattataaaaaatataaaatcagattttattaaaattagataataaattagaatatcgttccatatcaatatttccaccactaagaataatcccgattcgttgccctttcaactcttcccgcacctttcttgcagcagcaaaccctaaacatcctgtaggttcaacaactgttttcattcgttctgctaaaaagtacatagcatcaaccaattcatcatctgaagtaaccagaatatcttcaaccagattacgaataataggaaaagtgtattttcctagatgctgtgtttgtgctccatccgcaatggtttttggtgttgcaatatgaacaatttcaccttttttaaaagattgctgaccatcattacctgctacaggctctacaccaaaaatccgacattttggagaaaaatgaacagcagaaagtgcagaacctgataataaccctccaccaccaagaggaatgaacaaggcatccaattctcccacttcttcaaacaattctttagttgatgttccttgaccagcaatgatatgtggatgatcgtaaggtggaataaacgttaaaccgtactgattcgctaaatcacgagttatttcttcacaatcttcagtatatctatcgtagattactactttaccaccataaccttttgtcgctgcaattttggccttcggagcatcctgtggcatgacaatagtagcaggaatattgagtaaattagcagccaaagaaatagcttgtgcatgatttccagacgaaaaagtaacgactcccgcttttttctgttcatcactaaattgatataacgcattcatagctccacgaaatttgaatgctcccattctttggtaattttcacacttaaaatagacttcagcattgaagatttggttaacagtccttgacgtaaaaacaggggttttattgatatattttttaattcgggaatgcgcttctactacatcacgataatctggaagaaaattcattctttaatctcctgatctgagaaaaatattttatgtttttttaagcatgccaaccttaataccataattaatttgatattttttataaatactcagtaaaatttcatcattttattaattcctcccatctctgttacatgtactaattaatggctattttcagtgatttttcactatcaatcattaacacataaagtaactcacagatcaattatctccaatatttcatgctaaagccccacagtaaatctttatagttcaatagcatattattcactattagaaataattcccacgctatcttattaagatcatctctatacggcaaaaagcccacaatacaattagttcagaatactgattattaagttagattatattaacaaaataaaataattcatctttttattaacacataagaaacatttgttcgttttacttatctattgtattttaattacgaacaatcaaggaggaaaccgtggcttttttggttatgattatcgaaatctgcaagtcgatcctgagtggaaaccaggtgaaaaccaagctgtatcactcgtgataaaagcgggccaatgcgtgatcttctggtcaaccttgatgcatgcttcttaccctaatacttctgagaaacactatcgtatgggatttactacccgctatgcaccaagctatgtcgatatttatcccaatactgattatgtctacgaatatggtggcaatatcccacttgataaatttggctgcgtgatcgtgtcaggtcagagccgtaacaccaacaaccggattgcttctcataacttgctggatcaaccccttataccactatgaaggaagatgtcctgatgactcaaatccagtgctatctcaataatacatactgtttcctctccactggcgaagttatcgccagtggttccgatgaatggggacaatggattgctctaaataacaacctatttcatccacaaggcggggggcaacccgccgatattggctgggtgaataatgtccccgtgaaggttagaaagcaggctacagggcagatagccgtgtatccggaatccacacttcatgccccactgggtgcacaattgaattcaaaactatcagaagaggcccgtatatgtcatgcagcactacacactgctggtcacctgctgaactgggaaatgcgtcaatatggctggatggcaatcagcggccaccactttcccggagagtcacgcgttgagttctctcctataggctccagtgccatacctttcgatcagctatctttacaaaatatcgaaacgactatcaacactaaactacgtgatggcgggcaagtaacaacttggtatgaagcggatacccggctgtgtttaattgaaggcactgaacccatgccctgcgcgggcacacatgtcgataatctgaacaaaatcaataaatttaccattaagtcggtcaagttcaaaaagggaactctacgtatcagctacgatgccagccatattattttaagggctgacaatgtctcatgatgtattacctctatcccgtagacggctttatctgctagatctgggactactggctgttgccctttcttggggtgccagctattcgctgatgcaattgatcattcaagccgggctgactgtaccgttatttttgatgctgcgctttgctctatctgtaccttttatgtttcttggcactcgggtacgcctgcgtaacatcaaaccaggggaaattattaatggccttatattcggctgcctgctgtacgccatcctgacgtttgaaaccttgggagttaagtacactacagcatccaatgctgggttccttatcgccttgtctgtcgttatcgtccccttttttgaacgtatatttagaaaacgtaagcaaagtaagtttatttactttacctgttttatttctttagccggcggtgggatattaagtttttccgatacaggcaactttggctttaataacggtgactggttgatcctgcttgcagcgctgatccgcggtttccaaatctttatgtttggtaagcagacatccggtaaatcctactcattggttaatatcaccctgattgaactggtgacagtctccgtacttgggttagcctttgttttaatgactgacacagcatccctgcacctcattccaaccattacattcgatgtttggggatatattctgtttctgagcttactggcaactgcttttgcttttctgctgcagctctatgcagcaaaaaccaccagtcctactcgggttggcctgattttgtcgttggaacccgcatttgcagccctgtttgctgtcgcaattatgggagaaactatcggtattttgcagagcttcggcggagccattattgtctgtgccgctctgctaggacgtatcgtggaaggaaaacgctatgagtaatcaacgtcctcatatcgatagtaagcaggtataattatgttgacatgatgggggccatctttcccccatgattattaactttgaattgaataagacatgactactgttgcactaactgcaacatcaatacatatataggaatgtatgacatcaccagagaatgcataaaagtcaccgggatttaatatcacactttcatcgcttgaaagtcgtaacattaagacaccatcatgaaccataatgtgttcatgagtccctactgtatgagcgggactactaataataagttaatcaatgaaattatctgcacttttgttatagtcggtaatacaatacactgacttaccgcgtccactaatgaaatcgaagatagtcctttctgagcctgaacgaatcacgttgcaacaactcgccctgaatcatcagcatcgggacatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatgaaacggagttcgctaaaaaatccgtcttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttgattacttaacccctggattcatttgtaaatgccatatttcagcaacactacccaagccgatacgaaacttcatcacttgagaatatgtatcctccattggaatatttttttccagataggggtagcgctcattattgctgccaaataaatctcccagcggaagacgtagcgcaattgcaatagcatctaacgtatcaattcgagggttagagttgcctgattctaattgagatagtgcggccttagatacaccagacaacttagaaagttcgtttaaagaaatatttctagctaaacgcaatcgttttaccttgttaccgatatctatacaatttttttaactctatcttgttgttgagtattattcataaccaaatcaattttttagtgagaattaataaagactaacagaaatagatggaaacatcttcaaaaataagtaattaatatagctccccatttaattcataacattaattaaatggggagttatattttattaattattaaagagggcaataaaatgcttcagataaacgattgcttcaagataatctataccagtgccctattacttataatgccaggcccaacaaataccttactactctgttcaggattctctcaagggataataaaaagccttaaattaattcttgccgaatgtataggttatttactatcaataagtagttggggactattagttattgttctggcaaagcatagcccacttctcttactcacaataaaactaatttctgctctctatgtcgcttatctggcagtaaaaatatggcatttttccctacaggggtatgattatcatgtgactacaatgacaatattcttcactaccctgctcaaccccaagtcttttatatttgctgcttttattatcccaacatctgcattttcaatcagatatcaagctttgaacgtgatccacggcctgacccttgccacgggctgaattaatccggtctgttcttggatctcaatcaccggcgtaattggcttgtaagcctcaggcgcttcttcacgcaggcgatcgcttttcaaagtgatacactgccacggcaatcggctatttttttgtagatcaggcactttattccgcattgcctgacggcgtaccgaacgcccggctccgtgtgaacatgaccacaaccagtcttcattgcctttccccaatacaaggtaagaataatcccccattgagccgggaattaacgccaactcccctgcccgtgcaggtgtagcgcctttgcgatggagattcataccctgctcaggaaaaataatattatgcgagagatccacaatcaacttacttttatcctgcccaaaaacctgtttccaagccgcgcgcaccagttccgtcaaaacaatgcgattcgcccacgcataacgcgccgcacaacccatcgccagaaaatattcctgagcgtgttcatctgtcagaccaaataggccagaagatggatattttgccgtagccggccataaagccctcgctttatccatccaacgctgacctatgtaaaaacccacatcccgtgagccagtgtggatcatcatcaatacctcaccttcatgcaggcctgccgcgtaagccgcgtgcctgtccagaatggtatcgacgatttgcagttcaacaaagtggttgcctgaacccaccgtacccaagcttgccggacggatgatttcacgttgctcgaaaaaggcttcaggtgcgtatcggctatgcgcctgtactgcctgagtactcagtatcgcgtttaattcggcatgcatgcgcttgaaatcggcctgttgccagaccccctgttgaggtaattcctgtaaccatgccgccagcccttcgtcaaacagggcactgaatgaggttgatgtgacgggtacatcacgttgatccagcaatagggtattttttaactgctgaatcaaggcttctttttggctatacgcttccgcatagctcaaacccgttgtcagcaggcgcataccgcagttgatgtctgtcccaatggcagcagggatcaccagatcctctgtcgttgccacaatacagcccactggcgccaccgctcccggatgaaaatccggtgtcgctctggtacgacacactttcgcgtcgctgccgggtacgtgaacggaagcaaggtcaagtaattgctgtacggccttttcttccaatggcaaggattcaggcagtagaacttcagcttcaatttgctctttattgaaacgatagatattattttcgtactgggtttcgattccctgacgggataaacgtttttgtaaacgagtaaacgtagacatgttggctacctagaaaaacaaaaagttgcttcttccgttttcatggggaagaagtgttgtttttcctgcagcagctcaattcaggaagattttagcggcggtactttatccatgaattctgagattgtaaaggcctttctgatatcagataaaaaatcaccgcataaccagtatttcattattactgatagataaggctctgttttacaaccactttagataagggtttctgtttgtattcaatgtgttttcttacttgtctaacacaaaacgaggaatgacaggcaggcaatagaccaccccatcagaaaatgaaccgtaatctattgactaaatgaggactggattatgtcagacagtttccaaaataataatcttatcgaataaaaccatacttattaataaggttatatggagagtcagaatacatataaaattatccaattcatgcgtaatctcggttatatctccaagcatgctctaatgctgtttgaaattcttttcctttaatttctttagtgtattcttcacgtaatttttcccattcttgccaagattgacaatcactatcatttatatcatctagaaattcataaagcgttattatttcattttttatttactctatagtattcttccgactattaaataacgatgtatcattattcaaattaaatacacggatcgtttcttccgctttttgtctttctctgtcacacaaatttcgctgagggacaacatggccagaaattaagaaaagcaaatagtcaccaggatcttcttcatcaggtttgatcagtttattgatatcacatggtgggttcagctttctattatccttatatatcccacaacgtccccaccctccagttttttgaggatctccacaggaaccaaacagattaccccaattaaaagctttatctggaaacgtttcacgcttcctaaagtgctctatatgtttactcttccccttcaatctacattcacaataagcacaaaattcaccttgcatctgctccaattttgaccatatttcatccttcggaaccgctccccaactatctacgccatgtttaaaattagataaacagtctggagcttcctgacgttctaatttcttcaattttcatcctttttcttatcaaattttttacgagccttaactttcaagctttgaagacgaatgtgactttcacaacgtttaacttctggatgctcatcaccaaaatgttctttgatcttattgaataactctttagcattcgaattattttcataattatctttttcaaccaattcgattagatcgttaacccattttgactctggaagatccggaatggaaaaagtattcatcaattgttcaagaacatcgctatttgcaacgccctttgtttgaaaatcaggtactctcagccaaactgctcctgtatcatcttctccactaaaataacgaatattttttctattcactgtggacaacacttgtgggctatgagtagaaataataaattggatattgggaaaggtttcctgaagcgttgtaattatgctttgctgccatttaggatgcagatgaagctcgatttcatcaataagcacaataccatttccttccaaagggttttctttttcagggtttaataataccaatcttcgagttaaatcagcgactaaagcaataaatactcgttgaccatctgaaagctgagttaatttaactgcttttccatcaattaaaacgagaatctcatcaacaccagatttatctgtgacccaaatatcttcaacactgggtactacatgtgaaattgcttcaatcactttagaaacaataatagattcatgagaaccatcatcttgtttttcttccaaagattccagatatttatttttcatttcctttaaaatagaatcatcatagattgttgaaagaatttcattcataactttaatttcaatttgtttttttaattgattcaattcttcattgaaaattgaggttccatatttttttattttactcaaagaaataaaccaatctacaaaattttcaaatttgccagtacctctaagagcatcagtataagcatcgaaacgtaaccttcgcttttcaggtatatcgatcagaaaatttcttttattaattttcaaaggataagaacgttcaattaaatatgaagcaaataaaggaagattaattcttcgcttatcattaataattctccacatattagcaatagatttcaaacctactacttcactatcacgttttttcgatgcagcttcaattgctcttgataaacgagcatttattctagtgtcaacgccatacttgaattcagtataaatatcagcataaccttcactttcattatgaatatcgtcataggttataccacttccttgaccatcttcttttaagatattagcatttaaccaacttaatgttttactgatagcttcaataattgaagtttttccttcaccattagtgccaataaaaacagtaagatgtctatctaatcctttctcaatattcagttttttgaatcgacgaaaatctatgagctttaaggactctaatataaaattattttcttctatcagaacacaacattgctcaaagtaatattctgatagtgattcgttcttttctacattcatttctccgctcaaatattcttgatagagattaaaattagcgagcaaatcacctttctttgcattcatttccaatgcgcgaatatgtctattctttttcatgatgaccctatatcaaaaatattttttaacgtttctttcgagtacttctgtactaaacgaggaataaacaagggttcaatatgtttagcaaaagctaacaatccttgaagataacaaatatcttcaatacttagaactcctaattcgaattggtaaacaagatgtttaatatacctttttttttgtctacctatggataattttccatcattcgtaatagttactccagtgatatgccgattgtgtgcttttgatgaaaatattgtcttaccatgatttagcgtaatctgcctatcgaaatgttttatcaacaatttctttaccatctcatgtacagtaaataaaactcctgtttgattagttgaaaacgttaaatcatctgcatagcgagtataagcaatttgatatttgagacaaaaattatacagttcctcgtcaaaattgtataagaaagaatttgaaactgctggtgatgttggtgcaccaatacttaatacaagttttccactattttttttactcggacaccagaataacaaacgttgtaatatctttctgtcattatcatcaatgaatagctcttttttattccaactttcccataaaatattaggggtgattgagttgaaaaaattctccaaatccattttcagtagatattgattatccttatgataatttgcattatcttttatcgataaaccctgacggtatgccattgcactaggatgaacaggcagcaagcagcacttaaggaaagctgtttgatattctttaagccttttacttggttgagcaatgattctatggcctgaactacgcttaggtatagagtaaactttatattttttcggggcgtcagaaagaaaagtgatcgcttctctctcacttatccctaatgtttttactaaaccaaataaaacagtcattcaacctctgatagtgaaaagcccaagaacaaacttgggctttagagttactctttactaaagacagcgaattaaacgtgttcaataagttagagtctggctaatcacccgactagacgaagtttgtccaaaccgctaaagagcgttttaattctatgccaagtgatcgagtatcacaacctctggccttatttctccgatcccgtcctcaaaacagatataacttgcaccaataactcttcaccacccccaaccaacccaacaccttgccctctccccgttttgcgagcatgatcgcaatacctttacccgttagtcagaaagcccacatgcttacgatcaagaaactgcaaaccgctatctcaagcctttcggtatggcgcaagggggatcaacgtgcgccccataagccgttattgctactgtatgtactttctcaataccaaaaaaagcatgggcgactgtttaactacggggaagagctccaccagccattactggagttactcaacaattttggcccaaagcgcaaaaatcattacccaaccatgccattctggcggttacgcggcgatgggttctgggagttgcagaataccgaacgctgcacactccaaaaaggcaataaagaaccaccaaagcgcgagttgattgaatatggtgtgataggaggattcgatcaggcaagctaccaattactgcaaactaagcctgagctcatcgataaactggcacagcagattctcagtgaacatttccctgaaagcgtacaggagctaatcgccaatcagttggatttctccttaggtgatatccgcaagttacgcgatccacattttcgtcagaatatattgcgtgcctataactatcagtgtgccgtgtgtggctacaatctacgccatgacaatacccctgtcgggctggaagcggcacacatcaaatggaagcaatatggtggcccctgtactgttaccaacgggcttgcgctgtgctcgctgcaccattccgcattcgatatgggttcaattggtcttgacgatagtatgaagttaatcgtttcaaaaggtattaatggcggccagatggtggagcagcttttctggaattttgccgatcagccaatcgtgctccctcagcaaaaagaatattacccgcaggaagagttcgtcacttggcatcgcagccaagtctttaagcaataatccacacagattaaaaaggggagccatccgctcccctactattcaggctgttacaggttattgacccgctttcagtttctggaaatagttttcgtacaggatattggcgttgccaacatcgctctgccattctcctttctggataatggcttcatcaggatacagtgactggtctcccgtgatttctgccggcagtagttttttcgccgccagattcggcgtcggataaccgattttctgcgcaacctgtgccgcgatctccgggcgtagcaagaagttaatcaacttcatcgcaccatcgacattcttggcattggcagggatcgccagactatccatccagaaaattccgccttccttcggccagataatatcaaccggtgttcccgactggcgtgctacataggcagaacctgtccacaccatgcctaaatcaacttcaccttccataaatggattggctgggttatcagagttgaatgccaatacgtttggcatcagtttttgcagttcctgataagccgcttcaatctctttcggattggtcgtattgccggaataacccagcttcagcaatgccatctggaagacttcacgagcatcatcagtcagcaccagaccgttttgatactgaggcttccaaaaatcggcccaagagctgatggtttttggatcgatattatcgctgttgacgccaatggccgttgctccccaaatataggggatagaatattcattcttcggatcaaaagacttatgcagcagattcggatcaagatttttgaaattgctgagtttgctcgtatcaatcttttgcagcatcccctctttactcatttttgagacaaagtaagtggatggcacaactaaatcataagcgccgtctttataagttttcagcttggtatacatgctctcattggattcataggtggagtaaatcaccttaatcccagtttcgttggtgaactggttgagcaaaccaggtggaacgtattcagtccagttgtagaaatacagcgttttgccatcatcagcggcagcggcattcaccgaaccaatgctaaatgccatcatcccagcggctagcagatagaaccactttttcatgcagtgtttccctcgcagttggtgcgttagtcttgtataggctcggagtgaacctacccttagaaaagcggctattatagaagcgacatttcatggggtaaagccacttattccgtgttttattgacgttttagcaagaaattctgatttttcagggtaaaaagcgatgttgcaaatgaagtaaaggcgtgaccaacctgtggccacgcttaaatcaacgttaagctttgccagtacgatcacgcataataaactggctgaacaacaccagtaccagtgacattaccagcaaaatagtcgctaatgcattaacttccggcgaaacgcccacttttaccatcgaataaatcttgagtggcaggatttcatagcttggccccgtcacgaatgaggaaacaaccacatcatccatcgacagggtaaaactgagcagccaacctgccatcactgccggcatcgccagtggcaggatgattttacgcagaatggtcaactcacccgcccctaaatcccgcgccgcttccagcattttgacgtcaaaatctttcagacgggagtaaaccgtcacaaccacgaatggcagacagaacgtgatatgcgaaaacagcagtgaccagaatcccagtgagacgcccagcagcataaacagcaccagcaatgaaatcgccatgacaatatccggcgacatcatcaccacgaacagcataccgctcacgaagtttttgccacggaacgaataacggtacagagcaaccgccgtcagtgaaccaatcagagtggcaaacgtggcggaagtgaccgccatcgtcagggaatgtccggctgcttgaagcaagctgtcattgttgaacagcaggctgtaccattcagtggtaaaaccctgccagctaataccgaatcgtgactggttaaacgaacttacgatcaggatcacaatcgggatatacagataagcataaacgagggtcatgaaaccaccacgcaacaggcgtccgatcattccagttccaccttcttgttcagcagtttagccgcacgatagtaaaccagcagcatcagccccatcaccagcgtcaggcatatgctggttgccgccccaaacggccagtcgcgaatattaaggaactggctttttatcacgttaccgatcagcaggtttttcgccccgcccatcaggtcagccacgtagaacagccccattgccggcaacagtaccaacaagcaacctgcaataatgcccggcatcgtcaaagggataatgatgcggataaacgtctgcaattttcccgcgcccagatcacgcgcggcttccagacaaggtttatccaacttttcaatactggaatagagtggcatcaccataaacggcagcagaatataaaccagccccagcacgacggcttcggaggtatacataatgcgcagcggtttatcgacgatccccagccacagcaggaaatcattcagatagccacgggtgctgaggaacatcttcaaaccataaatgcggattaaagagttcgtccaaaacgggacgatcaacaggaacagcatcagcggacgcagcttctccggcatccgagccaagaaaaaggcgaacgggtagccgatcaccagacagcataacgtcgcgacgatggccatattcagcgagtgtagcaatacttcggcatacagcggatcgaacaggcgggtatagttgtccagtgaaaataccatctgtaccagattggcatcatcgcgggtcagaaagctggttccgatgatcatcaggttcggcataaagacgaacagcatcagccaagacaccatgcccgtgatgacgatattctggaatagtttacgcgtcttcttcatcgaccagcacaacctcccagctttctacccaagtgaccgcaatcttctggttcagggagtggtcaacatcgggatcgtcttcgttaaagaattcgctcaccatgaccattttgccattttccatttcgaccaccgaatccagcgtcatgcccttgtagttacgttcacgcacataaccaaccagacccgacacctgctcgccatgattgatctcttcgacccgcagatcttctgggcgcagcagcacttttagtatttgcccggcggtgactggcaacgaagtgaaaatatcgcattcgtggccttcgacgtcagcgcgtatccgctgctcatcaatacgatgcagcaccttagcatcaaagatattgatttcgccgataaagcgggcaacgaacaggtttttcggctcctcgtagatctcacgtggcgtaccatcttgctcgatgcgcccgtcacgcataaccacgatacggtctgacatcaccagcgcttcttcctgatcatgggtcacgaagataaaggtgataccgagcttgcgctgaagagccttcaactcattttgcatctgcttacgcagcttatagtcgagtgccgacagcgattcatccagcagcaaaactttcggcttgttcacaaccgcacgggcaatcgccacgcgctgctgctgaccgccagaaagctgagccggacgccgttgggcaaactcttcaagctgcaccatgcgcaacgcttcttcaacacgcggggcaatctcctttgccggtgttttctgcatgcgcaatccaaaagcgacgttttcaaatacggtcatatgggggaacagcgcgtaactttggaacaccgtattaacgtgacggtgctcggcgggaatatcagtaatatcctgcccttccagtaaaattttgccgctatccgcatcttccagcccggcaatcagacggagtacagtggtcttgccgcaaccggatggcccaagaatggtcaggaactcgccatcattgataatcagatcgagctgtgaaataacttgtttgccgtcgaaacccttgcacagggtgtttagttcaacgagtggtgtcagagaggtattctcagtcatttatgctatcatctatcccttgaaataatgcagatagaaccgccacgggaaaagactgtgtcagccagcaggaatcatcgtttctccgctgaagctcaaaccagtggcgccggttgaaattacgaagcgcgcataataaacgcagtaagctgaaattgaaagccgaaacaataacaatatgtcattttttgttatcatttcataaatgataacatcgcgctctatgttgtacccagtctacacgcctggaaataatttcctatcgggtattttgcaatcacttttaattttctttactttcaatgagatccttcagacacgaaaacccgctcttccctccattaaaactcacttgaaaacaccgttcatgctactctgccgcacttccggcgttatacagaccctgctatctctcctctccccctcgacaaaaacgcgccatccgattctttttttgaaaaaaataaaattattcgaattattttttattgctttaataacaaaatttataattcattgtttttaataaaatttaaataagtaagatcgttatcaccctttagaaaaataatccgagccccctactttacaccccaactctttggcgatatgaagagaatgaataaagattatttttacttattcgacaataaaaataacgtaaattaactcattgtcattttttcacctaattagctgaatcgtttcatctgattataagaaggtataaatagatgtttcatctatcgttaaaagatatccatctagcggcttacgctgacaataaagaaagcgccattcgacaagttaccgctgcactggccgcatcaggctatgtcagtgaaagatacattgaaggaatgctggagcgtgaaatacagtcctcaacctatcttggcaacggcattgccattccacatgggacaacagcaacccgcgaccaagtgctgcacactggcgtacaggtcttgcaatttcctgacggcgtggcatggggaaataaccagaccgtccatattgtcatcggcatcgcggccaaatctgacgaacatcttaccctgctgcatcaactgactcgtattatcagtgatgaaaacctcgccagccagatggcaaaaaccgcttcggcggacgaactctatcgcttattaatgagcacaccctcctcccattttctggatgcgtcaacgatcacactggatatcgacgctcatgacctgacaaccttgcaggccctgaacatcgcccgcctgcaactggccaaagcggtgaatgctgcattcattgccgatgttctagccagaccgccaattcatctcggccaagggctttggttgagtgacagtgcgataggcaacctgcgcaatgccgttgcgattaccagacccaaaacgccattcacaatggatggtcagccagttggagtactaatgaccatcgcctatgcggatgatcaactgcaaagcctgctgagccctatcagcaccctgctgcaacaaaacaaggccgaacgcctgtactccgcacccgatgccgcagccatcatcgcactgctgacaacagctacaccgcaggaagcgacggcactgagcgcagattttatcctgcccaatgagcatggattgcatactcgccccagctcactgctggtcaataccatcaaacaattcaacagccagatcaccatcgcccaccttgatggctcaggcgttcccgttgatggccgcaaactgatgcaagttgcgggtctgggcgtcaaaaaaggcgaacgcattcgcttcaccgcagttggctcagacgcggaacaagcactgacagcgatcacagccttgattgagcagaacatgggtggggaaatcgcatgagcaaaagagtggcaaccatcacccttaaccctgcttatgatttagtcgggctgaccacggatatcagcatcggtaaggtaaaccgcgtccagaccgccggattataccctgccggcaaaggcatcaacgtaggtaaaatcctcaaaaacctcggtattgacgttaccgttggcggttttctgggagaagataatcaggacagcttccagaacaccttcgccgaactgggcatgaacaatcaataccagcttgtggaaggccggacacgcattaacgtcaaactcaccgaacagagcgacatcgtcactgatttcaatttctcagggttcagcgtcagcaaagaagaatggcaacaattcgccaaccgctccctccaatggctcagtgagttcagtatggtctgcgtcagcggcagcctgcccgctggcgtcgatttggatgacttcacccactggatgcagcgcctgcgcgaagagtgcatgtgcgtggtgtttgacagcagccgggaagccttcgttgccgggcttaaagccctgccctggatggtcaaaccgaatcgccatgaactggagatctgggctggccaaccactgccgacacaagaagatattgtcaccgcagcccatcaactgcgcgctcaaggcgtctctcatgtcgtgatatcactgggagatgaaggcgccattttggtcaacgcctctggcacatggctcgccaaaccaccgcactgtgaaatcgtcagcaccgttggcgcaggggatgcgatggtcggtggactgatttacggcctgatgatggggcaacctagcgagcacaccctacgcctcgccaccgccatatccgccctgaccgtcagccaaagcagcgtcggcagcattgaccgtcagcaactggctcgcatgatggcacgagtagaactcactcctctgcacactcaatcagcgaaaaacaattaaaaaaagagcaaaaagaaaaacagagagaagaaaaccctatgaatacattgattcttaccgacaatcagcagggacaggcgcgcgcttaccttgccagacatacactggagaccatcgccgcccaacacggcctctcccttgtcacggatgtgaacaacgcagaactggtgattatcatcggcgattctgcgcctgataacgttaatctgcatggcaaaaaaacttttgcaggcagcgcagaacaggctatccgcgaacccgatacctttatcagtcatgccaaaaaccaggccagcgtttatcaatcccaagatagccatcactcgccggataacgcggttcagcacaacacaatgaacatcgtagcgatcaccgcctgcccgacaggggtggctcatacctttatggcagctaaggcgctggagaccgaagcacaaaaacgcggctggcagatcaaagtagagacccgtggttccgtgggaaccaacaacgccatcacacgcgcagaaatcgtggcagcggacttggtgattgtggcagcagatatcgacgttgaccttaccccattttccggcaagcgcctctaccgcacctccacaggcgcggccttgaaaaaaaccgcccaagaattggataaagcactgaccaccgccgagatttatagcgccaagcgtgaaacttccgcctccaataaccccaaacccgcaggcacaggcgcttaccagcatttaatgaccggcgtttcctacatgctgccgatggtcgtcgcgggggggttgtgcatcgccctgtcatttgtcttcggcatagaagcatttaaagaatccggcacactggccgcagcgctgatgcaaatcggcggcggctccgcactttcgctgatggtgccagtgctctccggttacatcgcctactccatcgcaggacgcaccggactcgctcccggactggtgggtggaatgctcgccgtcagtaccggcgccgggttcctcggcgggatcatttctggctttcttgcgggttacattgccatgttgctcaccacccgactgcgcttaccgcaaagtatggaagccttgaaacccattttgattatcccgctggtcgccacgctggtgacagggctaaccatgatttacgtcgtcggtaatcccgtcgcggcaatgatggaatggctgacccattggctgaaatcaatgggaaccaccaatgcggtgatcctcggtgcgattctgggcgggatgatgtgcacagatatgggcgggccagtgaataaagcggcttatgcgtttggcgtcggtttgttgagcacccagacttacggcccgatggccgcgattatggcggcagggatggttccgccattggcaatgtggctggcgacggtgattgcgcggaataaatttgaccaaagtgaacgcgaaggcggaaaagcggcactggtgctggggctgtgttttatctcagaaggggcgattccatttgcggcgaaagatccggtgcgggtactgccgagttgtattctgggcggcgcagtaacgggggcgctttcgatgtattttggcgtacatctgatggctccgcatggcgggttgtttgtgttgctgataccgggagcgattacgccggtggtgaattatttgggggcgattgtgatcggcacggtgctgactgctggggtttatggggtggttaagaagaaggctgaggtggaggttgttggttgagggagtttttgtaggttagtaaattttgtggaaggagttgcggatcgccgcaactcctatggtttctctactcatcaatccgataacgatttatcccccgcatttgcggggaacagcaaccttgaccgttatatgttcgttaacactacggtttatccccgcatttgcggggaacagagcacctagggctagaatcaattggataccaacggtttatccccgcatttgcggggaacagactaatttcatgctattgtttttaattagttttttcaagggagaaatttctaccgcatttttcccataaaaaactcactttatcaaagataaaaatatgtttattttcaacatgttgaaaataacaaaacacaagccatcacaatctaccaataccctgcactaagcattttcgatacaagcatcggttctaatccccaacaactatactaccaaacaatccatatgagcccgatggcagatgttcaatgacaacaaccaacatttttattggtaactcttgtaactaattttaccaaaagaagtaagttctaaaattgtcggtggtgctatcaacccgacgactaaaattttttcaatcaaaggcatttacttgccaattatctatgagcaaagaaaaattttttgacaaaccaaacgcactattaatcaggtgctagagaaagcaaaccgcaacctatagctttagccggcccaatccctttacttagaagagaaattaagacttcactctcctgtactgtgatttgcccctcaaaacatattggctgaatttttccactaatatcacttttacgaaaatagattggaggctccgatatcacccaagcagtcgataacagcgccgctcccgctaatttacgagataaccactgtaattgctgttcctcatggatgagcggtacgcggcaacatttgagttcaccgtcacgagtacggcgctgtcgctcatctttgatggttttgaccggattagcccgcagcttgaaacgtaacttagcaccacaaggaatacgcaatggctttactagcgataacctgagccactttcactgacgaaggctcctgtgctgactgcaataaaacgcccacaccccgatcagattgccactcctcaacccgaaaaagaaaatcgcgcgcatcatcaggacgattggggaaagctgccataaagcccgatgcagttgatatggttctttcgcccagcgtcagtcgatccagccccattctttgccaggttagttatcattttctctgaaaaatcatctggaggcgcggagtaatacatgaaacgttaagtaccgaaatataacatttgcagttaatgttacccactcacagcaaaacactagcaacttccatacaagttttaataggcaaccacatttcaagacatgaatgttcatcgggctcaaccgataaaaaatcatactgctgataaaacggaatgacttcaggactcattggatcaacaaataatccgatagctgatatttgctgtgaaactaacaccgttcgatagatagcatcaatcaataacttctctcctaatctttgtccttgatatgaactatccacagcaagacgagctaattttaccgcattaagtgggtggggatattttttataatctctgtgggtcggctgtgttatcacggaatacccactaagagtataatatccgaggatagtcgttggttctgaagcccggcaaacgacgtaagtttttgagatatgttttatggccttctgtcgggcttgttgttgtaagaactgatttaattcacgttcacggacaccgcaatcaaatgctttacggttatgttgttgagtgatttcttcaattatcaaggacattcacttcatccttgtaatctgcggctgctttaagaagcttcttacttacttttggtgggttttccaacgccacaaataatgcatctgtacctgccattgagagctgcaatatttctgcttgttcaataacattgcgtgccctatccattgccgcttcaataagaaactgcgaaagggttgcaccagagtaatcggcagctctttgtataagttcttgtatttctaaagatgttcgcgcaaccaaacgggtttctttacgctcagaataagtgcccataatttcaccttctcttcaatatagatcaattccagatagtgccattatggcacacaaaatcaatttataccaaattgtatgccataatggcatacaaaaatacaatacagttatcacgatggacaaccgcaacgccatttcaagcgtaacgaacctatgcccagagagcaatttgctagcaatggagggatcaatctccattgatttggcgaactgccgtaagcttacattcatgttttccaatgtttcagcaatgatttcactaggatgcacatagttaactattcttattagtgataaccctttaaagtaaaaatttcagtatcgatgtcataaatttctgaattcagatgtttcatttagcaataaatgattatattttttcttctttccataaaaaatagttaatctatttattgatagttctatctcactttactaaaagcagatttcatcagaataacaccaatccaccgcacttttaatcaactcctccgtagcatcaatatacctatccacattaccatccctactaagaataagcggtatttcagtacatcccataacaaatttttcaaccccaaaagattgcagttgagatataactcctttcagtaaaaaatatgcctttccagcatttccacctttataagccagaatactttccataacacaacgctgttgaatatcatcaagaataacacaattgatattctctttttccaatctggattgataaagttcggattttatcgttgctgttgtggcaagaatagcgacattattaatcctttcatttacgattttattacaggtgatatcaatcatattcataaagttaatttttgttgctgcttttaattcgttataccagtaatgggcagtattacatggcataataatacactgagcgccagcgctttccagctttctcaatgcaactaacattttatttaacggcgatgcgccatcagagataatattcgctgtcctatcaggaatttcaggaaaagaaaccgcaatgacaggaatatgttcttgatcgcaagttgccggtgtatgtttaattattttctccattgcatctacggttgcagcggggcccataccgccaagaataccgattattttcttcatatgccacctcagtaaataatcgttatgatggcacagtcgtgacggttcgtaattgcaatgtttccatggactatgctgaatttgcataagagttttcatgcataacagccaataatcattatattaatagggtagcattatgctgaataacattgagctgaaatggttatatgatgctgtaatgttggaagagctaaggaatttcactcttgcagcagaaagaagaaatatatcccagtcatcttttagcagacggattcaggctcttgagagtgctgtcggctttgaaatattcgaccgtaatttcaatccattacagctttctttgcagggaaggagctttattgtgtatgccagaaatcttctgagcgatatagagcatcaggttggcaaaataaaaggaggagaaatagctaaacaccgaatcaatatcgccgctgcacattcgcttgccatttctctgttgcctgagtttatttctggctttgcagaaaagtcggacaaaatttttaatgttgaatcgatcaatgttgatgaggctgtgcataatcttaaagagggaaaaagtgattttattctgtctttctttaatgaagaactgatgacgtcccccttccttcatcataaggtgctggatgctcagttacatctcgtatcgggctgtaagcctgatggagagccgttatataatctggatagttcacctttgccattaatgaaatacaccgatgaaagttatatggggcggcaagtcaatcaattactggaaaaagatttcagcgacgggttcaattatttttttcattcatccatgagcgaactactgaagcgtatggtgctaaatggtcatggggtgggttggctgccggattattcaatcagtaaggaactcaaaaatcagcaattgtgcattttgggtcaagattatgcctcgataaaaatgggcgtgtacatttaccgcactcactcccggctcaatccttcctcagaacgcttttggcagtatatgcgcaaacgcgaaagcggtagccagtaaaccaatccccagcagcataggtaactatgtcactggggaaaaatacactctctcactcaggcttcttggtcaaccggttccaattcggaacgcccctgcttttcttccagtttagcaatcaccgcggtggaaatgctgttaccgacgacgttggtcgctgtacgccccatatcgaggaactgatcaatggcaaggatcagcaagatacctgcctcaggaaggttgaacatgggcagcgttgccgcaacgaccacaacagaagcacgcgcgacacctgccatacctttgctcgtgatcattagtgtcagcatgattatgatttgctctgtgatactcaggtcaatatggtatgcctgtgcaataaagagtaccgcaaaggattgatacatcattgaaccatcaaggttaaaggaataacccagaggcaagacgaagctggaaattcttttcggtacgccaaatcgatccaatgcgttcatggtcttgggataggctgactcgctgctcgcggtagcaaaagccaacgcgacaggctccctaatcagcctcatgagtgaaaataggcttttcccaaggaaaagaaatccaaccgccgacaaaacagcccatagcaaaaataagccaaggtaaaagaggccgataagtttgccataatcgtaaagcagccccagaccttgcactgtaaccgcagaagcaatagccgcaaacaccgcaatcggtgcgaatgacatcacgtaatcggtgatgcggaacatgatacgccccagatcttcaatgaaggtcactatcgggctttttttcttgctgttatggcagacatatgaaagcgcactaccaaaaaatatcgaaaaaataaggatctgtaagatttcattattcgacatagcggctgcgaaactactggggaaaatatggctgataaagtttttcagggtgaatccgctggtgttgaggcctgtatcaacattgtcctgttgaggaacactgacattaagcccaacgcctggctggaacaggttagccatcagcattccaatgccgagtgaaaccaaaccagcgataataaaccaggccattgctttaatggtaattcggcctacagatgatgagccgccgattgatatcaggcctgcgacaatcgtggcgaataccagtggggcaataatcatttttatcagtcgaaggaatacatcggtaatgatgttgatataggaggcaacttctttggtctggctggcatcaagataatgatgaaaaccccagccagtaataattccaagcagaatagcgatgatgatttgcttcatgagtttttgtctgttcatacgacctcttaattcactgaaaagaaaatattgaaattatttattttgtttttctgttctttagcttttcactcgcacaaatactgacctttttttaatttttgatgaaatgcaaatgaaagaagccttatgcagaaaatgcataatgtgattggatattctgttgaaatagtaaataattacacaaaatttgtgattaatatcaatatggtaatttagaaataaacaattaatagcgtatcatttttccaaaatagtattaatttctcaattaatatttcaccaagtctttataattaggatattttactttatttattaatagttttcacataactaaaacgcctaacagaaaatcataatcatcggtcaaataaattttcaacgaaataataataaatcaatacgagatctattaaaaacgaagctttattcttgattattccgttagaatcaaaaaccgccctacgcacctgctttgataatggcttgtttaacctccatcgttttcagacgattaaagcccgcttcaatcgaagtatctcccccatagccgtgcctcatcatcgtcagtcactaaagcgatatcagtgataccgtacacttgctgcataatgccacggacagaaaattcaggttaagcaagtttttcatccacttcatgccagatagactcggcggattcagagccgaataattttccggtaataccaaacgggcaacgcaattccagatgtgtccagtgataaaacggattatcgattgtcatgggaacatttttttgcccattcgaggtatttcttataattgctactggcagagtcggtgatcagagactcttcaatccctgccgaacacatagcatgccattttttaactcgctcaagaattccttgaagagagtcctcctcaccctcaagaggataagaaataacatcactctcatctggatgctatgtgtgtgggttttgagatatccctctcaccaacccccactatcctcaataagcaataaaattttcaactttcgctaaaaaaatattgatttcatccattttttgatcaacttttaaccatataaaattcttgaacacaatgggatacaatgatgaatgaatcatacaaaagacaaaaatcaaatagttaaagttgctcaatatcttcgaatgtcaactgaacatcaaaaatattccatagaaaaccaatcggtttacattcaacagtacgctgaacagcacagtatggccattatctacacctatgatgactcagggaagagcggagtaaccctatctggtcgtaacgccttcaaaagactcatcgcggatgtaaccaatcgcgtaatcgatatcgctgcaatcctagtttacgatgtcagtcgttttgggcgatttcctgacccagatgaagcagcccactatagttatattctgaaaacacataatgttaaaataatttactgcgcagaacctctatcagaggatcaccctgaaataagtatgctggctttgcctatcctgagatatggagccgcatccttcagtaagaacttatcagaaaaggtcttcgcgggtcaggctaatcttataaaacaaggatatcatcaaggaggaatggccggatatgggctaaggagacaactaatagatgacaagcatgaaccaaagttgatccttggatatggacagcgaaaaaatattcaaacagacagagtaattttaactcttgggcctaaagatgaaataaaaatcgtgaatgaaatttatgatttatttatttttaaaaacttccctgaatatctgatcgcaacacaactgaaccaaaaaaagataccagccgaaaataatggaatatggacaagggaaaaagttcatcaaatattgacaaatgaaaaatatataggtaataagttaatcaatgaaattatctgcacttttgttatagtcggtaatacaatacactgacttaccgcgtccactaatgaaatcgaagatagtcctttctgagcctgaacgaatcacgttgcaacaactcgccctgaatcatcagcatcgggacatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatgaaacggagttcgctaaaaaatccgtcttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttgattacttaacatttataataaaacctctttcaaacttaaacaaaaatttgtcaaaaatccaagaaatgaatggatcagatgcgatggtgcatttaaagctattgtccccagaaaaaaatttcttctggctcaacaaataattcaaaacagaagtaagcacttaacaaatgaagatctacttaactatctcagaaagaaacttgaagaaaaaggaaagttaagtggttttataatagatgaagatgacactagcccttcaagttctgtattcaaagctcggtttggaggactcataagagcctattttttgataggatataaacctgaacatgactactcatttattcaaataaacgaaaatctaagagaaaaattaaaaaccatattaaataattttatagagtcaataaaatcaaaaaattgcattataaacaaacatgaaaattcactactaaacattaatgacgaactttcaatttcattaattatctcacgttgcataaaaacaaaaacaggaaaattaaaatggaaagtaagattcgagaatgtattgtcaccagaaataactattataataagaatggatataaacaatcttaatccagttgattattatatccttccgagattagatatagtttatgaagagttcgttataaaggagaaaaaccctatctttcttgaactttatagatacgataacttagatttattcttcgaaataataaccagacgagaaataatggagtgtatatgaaagagaaaacaaatgatagtaatcataacattgaaatgattgatatttcattgataaaaatttcaaatccaagaccacgaaataaatttatacaccaggaaattcagagtaacattgatattagtggattacgaaaaccaataacagtcaggagaattaaagataaaaaatataaatattctttgatatgcgggcaaggtcgaatggaagccatatataacctaagcaatactcacattcctgctattattaaagatgttaacgaagaagatggatatataatgagccttagtgaaaatgttgccagacgaaaaccgagagtaactgagctatacgaaaggattagagatatgaaaaataatgggatatgtgatcatgacattgcttctatcatcggttattcagtaagttgggttaaaagtgttattttattattagagaaaggtgaacaaaaattattaactgctgtcgaaagaggacacatacctatttatcttgcagtaaaattcgcgagatctgatgataaatataatcaaaatttacttatagatgcttataatgatggttcaataaccaataagaatatagcaacaataaaaaaaatattggaaaaaagaagcttgggtagtaaaggcggtacaagccacgactatatatatcataaaaacaaccaaaatatcactcctcaggaattactatcaatatacaaaaaaaatgtcgaagagcacagattacttcaagctaaatctgaatatgtcatagacaatttagtattagcaaaacagattattagtgaactacttttagaaccctcattcaactctatattaattacagaaaatctaaccaaaattccatcaataattatggatactgcaaaacctcacgaggattaaatcatgttaaaagtatgttttaataacgaactgattgatttatccatcgaaaaaatgatggccagtaagcccttacctgaaaatgtaaaaagtagtattaaatataaccagataaaattatctataaaagaaattggtcttatagaaccaattattatctattttgatgatactggaaaaagtataaaaattttagatggacatcttcgtattgaggccatgaaagaattaggaataaagaaagcctgctgtattgtatccacaatcaatgattgttatacacctaataaacatgtcaatcacttaactataattgaagaacaaaaaatgcttaaaaaggctttgatatcaggagtttcaatagaaaaattgagtgcggcattaggtatatcacaagaaacacttaaaaatcgttttcgagtaacgcagggaatagcctctgaagcagcatcactactatcagataaacacataccagtagcaagtttaaatgtattaaggaaaatgcaaccattaagacaaattgaatcagcaaacataatgacaagtgttgataatttctcagcgaaatttgcattatctttactccatgccactccagattctttattaaaaaattcaaatgtaaaaaaagaaaaatcagatatccaaaaaaacctaaccagacttgaaaaagaaatggcaatggtccaaacagaaactaaaaaacatgaagagcactatggtgcaaacacacttaaattagttattataaagtcccacatagctaacctattaaataacactaaaatactgcattggctttttgaaaacaaacctgattacttaagtttgttgaaaaaaatttcagatttagactcactaacggaacaagaaaaatgaaaataatatataattatcaatacaatatagaaattcattccacctaaatagtaaaaattttcaaaatcatataattagctctttgagaaaaaattttataggaatcattcgcagttttaatctgtaaaaatgatttgattttattctcaatagcttgtttgttgatagcaaaaaattgcttttagaattaaagtcatgccacaaactataacatcggattataatgataaaccatctttaaaatcgctattccgtaataataagtcacttcgaaaattttaacaaaaatgagatttaacaaattcaaaaataactgaacatttacctctgcctattttattaataactttagatttcattaaaaataataaactataattatttcactaacccaaacaaccacattttcattgagcgctattaatatgaatgatagtgtgtgaccaagcaccaagttagtaaataaggacaggctcttagtcaattagcacatttatttttactcaataaccttcaggagaaagcgatatgcacaaaacggctgatatcttagaaagtaaaaaccacgttgaatcaataacaaacataaaaccaacgataggtattattttaggttcagggctggggtcgttcgcagatacgcttgaaggtgcagtccatattccatatagcaatatccctcattttgcaaaatcaggagcggttggccactccaatgaattggttatcggttctattggcggcaaaaatgttgtcgtgatgaaaggacgttttcattactacgaaggctttacgcttgatcaagtgacattccctgtccgtttaatgaaagcactgggtgttgaaaaactcatcatcaccaatgcctgtggtgctgtgaataccgatttcagccccggcgatttaatgctgattaccgatcacattaacttaaccgcaaacaatccattgattgggccaaataatcccgatctcggtgtgcgctttcttgatgtcagcgaagtgtataacaaagcattgagaagcatcgttattgatgtggctaaagcgcaaaatatcacgttacgtcagggcgtttatgcctggtggacggggccgacatatgaaactcctgccgaaatccgcatgattagaacgcttggggctgatgccgtgggtatgtcaacagtaccagaagcactgattgcacgacatgcagggattgatacagtcggtatctcctgcttaacaaatatggcatgcggtattctggatcagcctcttagtcatgaagaagtcattgaaacagcggaaaaagtaaaagcaacgtttcttaaactgatagcagaaaccatttctcgcttctgacttttcagccaaaatagatttcaagtttcagccaacaaagcagcaacttgaaagatgaggcgtatcgtaaaatcctacatagccactgcatcaaacgtgatggaagcgacaaattccacccccatcttgtactaaatcctgaggtgacgcggagaatggagccgatcgttgaatagtcgcaatcgcttctttatccgctttcacaggatcggatttacgacaagatatcggctttcggatcaatcaacaatgagagcaattgcgctatcacgtagccggccgaacgagacccgattgtctcccttgatacagtgcgccacgcgtctagtgagcaggctaaagcctattatcgcgattggtatcagccacaacgtatgacactcgtagtgatcggcaagctcccgcggtaatatacaagctcaggtggcaaataaagccacctgaatgccaagaaaaatcaaagtgatgtaatatcaaacggagatcgattatgaaaaacacaacaacacctacgctggaaggccataccatcacggaatatctgggtgtcgtcacaggggaaacgattcttggggtcaatattattaaggatttttttgctggggtgagagacatcatcggcgggcgttctggtgcttatgagaaagaattgaaaaatgcacgggaaatcgccttcgtggaaatgaatgcacaagcccaagcgctaggagccaatgcggttgtcggtattgatattgactatgagacggtcggtaaaaatggcggcatgttgatggtcactgtctcggggactgcggtgaagattgtgtaaagagggatagtaggcaggattttaggttaagccatcttattgtgaggtggcttagatttatgattattctttatcacaacggtatcctctgcatataccagccagaaatatgtctgttgcagacacacagagaaagaaaaccgtctttcccaaaataaagtgatacaaagtatgagccgacgtggcaacggtctagatattcaccgatggagcggctgtttcgcagtttgaaaagtgaatggaggcttttagggggtacagtgatatctatgattcgataagagatatcacgtaatatctaggcggctattacaaccaccatcgtcctcatagtcacaatgatgaaataacatcggttgaatacaaaaaaacagtgggaagagtctatgaaggtatccggtattaattgaccacaacagtttatttttggtccgaattagggcacattcagccagcaaaacagggtcgagaacggtagtgcaatgaaattacaggcaaagaacccaatattttaaggggcgctacaaaatatcgtcatgaaattttcagccaaagtgcaaggcaacggatttgagctgcggaaagaaataaagcactatttttcgcatatcgggtcgctataccatcccgtgtcgtgctgcttgctcaactattgcatgactatcataggtcccgatctgaacaaatgttcagcctccattccctcaattaatgcttcagcttgtgagtaatcagctgtggtacctcttgtaacaagaactctgatcggcataccatgcgcatccatggccaaatgtatcttggtattgagcccccttttgtgcgccccatatcttgattaccgcctttagtacccgccgcatgaggatgaactttgatatggctggcatcaatcatcaaccattcgaaatccggttcagatatcagttggtcaagcaaggcttcccatacacctttatttcttcatcggcaaaaacggcgatgggtatttttccagtcaccgtaatcgggaggtaaatctcgccagggagaccctatccgtaagatccaaaacaccgcattgataaacaatcggttatcttgggcttcccgaccccatgcgcctttacgccccagtaaatgcggctccagtaagttccaaatatgatctgaaatatcatgacggcggtgtgatggtgtgctcattaccaatcaattctatttatggaagatatatcgcttatcacataatttttttcatgacgacactacctgacgatgaaaaagattacccatgaacttcggggcaatgtctcagcagtttgggtttatcaagtacaacgtcccgcatttgaaccgacacaatcactcccaacattaccgatgacgagattgttttggagatatcctcacttaaatttagcaagctgaggccccaaaatttcatttgctaactgtagaagtttattgttataaggtgaacgagtccattgggaaaaatttgctaaattatcaaaataacgatagtcaaattcaatagttattcggtggatttctcttggagtgttataaccttcctttaaagtaaaaacacaatccatcttttctaccaactcattcccctgaacatgaatgtgatgtcgagtataatatgttcccaactcaatatactttttacagtcaggatgtttgatcaggtacccattatcattgagcatcaaatacttaggaacttggttgatgagtatctcagccagatccgaagaaaggatttttttaaaaagaattacttgattatcagtcatatatgcaaattgccaaggcacgttcattaatgtagctcgggcgtacagccatccctcctcatctctatactgtaggagcatactttccgctaatttttcatcaatacggatacccatgtttttacttagaaaaaatacaatcttatcaaaatgacaaatcagtatttttaagatttgccctgtaaggtagcttggctcacgcttagggcgttcatcaggattgttgatattttttttggaatagggacaccatgtatatgcctcgtgatcgtagacccctacccctggtacagatctgccgaaatgtttgccatatgggtgaggagtattgatcgagggcttatagaatccaattatctggatagggttatcgcaagccgggcaaatagcaaaatactgtggagaccctgtatcgctagttttataccaaggagacctacgcgaagtacgctgttcataatcatctttatcaatagcgtaatagcctttgtaatcaatggatactttataaacattcatgtatttattccctattctatatctcatcaaccgttccccctgctagcttacctcatcaggaacgggggaataacgtataggataaaactcagtccatattcatcttttaatcctttgacatataaaataccctttacattaaattggagcagggctaaataaacaaaatcatctgattgaatttcgaaaaaatctgggtggcttctgcaatcgactcttttcagaaaaatatacaaaaaacttcccaataacaaaaaccataattacacttatgcaaataaacacataaatataattatgaccaaacaaatccaacctaatatcaaaataagaagctatccaacttggtaggattaaaaaaaggagtgccgataaaccgcctcctgccatcattcctgttttgaccaactcattccgttcagctcgagtcaaacccggaactacttcagcatgacatcctatacaaactaatttttcaaccccaacaactgtcccacagaaagggcaaatccaaccttcttcttgctcgataaatttaatatcatctctagatgtggacttatctatcattcttttagttccacgttctgcttcacattcagctttatttttccattcatacaagcgtcgaacagggtattttaaataatcagtatcgataaaatgagcacaattttggcaaagccagataccattttctgcagactttcgttgttcagaatttaaagacgaatcatatctcgcgccccctggagaagcagctgttatatgagcggccaccccagttttagttgatttttcaggatgagcattaggcccggaagtcagaatattacaatctgggtttgagcatctattcccgaccctctcctgaatgaccctcttggttttttctgtaaatctatcattcattgttagattacctgttctaggacctgaatgtacttattcgttgatattaaatcaaaaaataaccaaaaacgagccttattaacacattatcgataggtaaaacggattcagccggctcgttgtaccatgaggttaccgtcgccatctgtaagcttataggctttagcttcaggtttcgcatcactcagaacaatgttgagtatcctttcaaaggttctgtgtaggtacaaacattatcgaaccgggaaatagcaatatagaaacacccttctgaggtaatttttagtttaaggaactttcatcgccagacggaagtttatgtgtccgacgatatctgcttccaaaaatgtgcagatgtaccgcaattcttgctctccctttcaggctacgggagttttgttcaccacctaaaagccgatcctgacaagcgatggatcgtttttgttgaataagatatgaacaattaggtaagggggagtcaaaccgttgttgtgcctccttcccttattttttcctgagtttctcctctcctcacatccattcaagatcaggcaaaaataggatttaagacgttactgcattaccagttactgggataaatcgaccgaatttatcatttatttcataaatctatttggtcatgactccaaaggagttgtaatgatgtttttcaatatatgcgccaatgagtttttcgtggatttccattgaacgtgagtaacaaattgttcttctcgccaacctcttgatatgaattcgcagattgagattatgccgctctatacgctgggtaaaaattttgcctaccagatgcttttctggcaccatttctctggcgtaacttccccagttatcggtggtgatgaaacgaatattaaaagacgccaataagttgagcaattttcggcaggttgcatccgttcgggggccaaagacatgggcggtgacttgtttccttttcgtatcaaaagcataccaaagccaatgacgttgttttttattgcctacaaaagacccttgctcatccaattcacagataagtgtgacatcgtcataagcgatctgtcgcgatgttacttgttttggcgagagttttttaatgtccgcatcaccgtattgataccgagacctaacacacggcctgtgtctctcacaccagagccattcattgccatatccacaattttttctttcatgcccggtttatggccgttgtaacgatagttgagttgaaaggttctttggcagtctttgcaatagtaacgagggaagccagccttacctgtaccgtgtttgcgtacaggttcagcttggtcgcaatatcgacaagtcacttctatcgtaacagtcatgatgatgtcccattaaaaagtacaagaatatcaaattaacgctttgaagtcatgaccatctatttaaaaaataatcattcatacatatttaatcaatgtgatcaaggtaacatttatttaactttaacagacgccatataaaattttcaattaaaatgagccgtactaaaaagtgagccaaggatatgtagaaatgataaaaagcataacatatgaaggaaagaaaattgagttatataataatattaacaatagagaaaatatattttctattattataggaaagaatggcacaggaaaaagtcgcctgttacagttgatttgtgaagagtattcaaataataacactcctaaaataaaaaattctccttctagaattatagccgtatctacaacccccttcgataaattcccactgaagaataattttaaaaaagggtattattatcaaggaattagagggattcaagcccaagccattagtaaaggatatatctctaagtttataggtgattttttactgggtataacagaaaataaaataaatagtttatctaaggcgttggaatatttgggctatgaagataaaatagcaatttcatttaggtatataggcgggaaaagaatagaaaatataataaatagtaatgaatcagacataaatgaatctttaaaatatcatccttacttcgaaagtatagttttaaataaattaggaatagtaaaagaatattctacaaacagaagagtttatgaattaagatcttatttagttgaaaagttaataaaaggaaaagaagaaataaatcaattcttagtaaaagatgataaatctctacatgaattatttaaatctatttgtaattctccatggttacataagataaggaaattgaaaatgaatataatagggaaaaatgtagaatttaataaagaattatctctttctaaggatttgattaatttaattaattcaggcttattgaaaattgaaaatatcattttaaaaaaaacaaactcaaaagaggcgtttcatatagatagtgctagttcaggtgagcaaagtgtaatcatgaatatattaggtatttcatcggttataaaagataattcactaattttaattgatgaaccagaggtttgcctgcacccagaatggcaagaaaaatatataaaattgttaattgatatatttaaaataaataaaaaatgccactttattattaccactcattctccgcaaatcattgcaaatttaggagaaaagaattgttttataacttcaatagaagatggtaaatctaagaaatccataaattatattaacaaatcctctgattttcagcttgcaacactatttaattctcctggctttaaaaatgagtatttaactcgattatctctaaatttattatctaaaataatatccgaaaaatctgtagaccatgaagataaaaaaatcatggaagaattacttttgataaaaaataaattgcatgaaaaagatccattattggagttgattacttcattagatgaaatggtaaaatactatggctgatattaacgaaccaatatcttatagtaagaactctacagagtttatctgtaaaaaaaaatcgactgaaaatttttctcacactcaatgggatgaagaaaatttaaaaacagttagaaaagaaataagagattattacagaatgaaacaaaatggttgttgtgtttattgccgaaatgaactatccataacttcaccaattaattgtcatatcgagcatattgccccaaaatccagatatttaaatttcatctttgaacctaggaacttatgtgtagtttgtgctgattgcaacacaataaaaaaagataaagaaatcaaaaatgaatgcgaaaacactatatcatcaagtgctaaactttaccctcgtagctcaaaggcattcagcgtttatcatcctcattttgatttttggaaggatcatatcgttaaatttaatggtgaaatttatgctgatttaacagataaaggtgcgaataccataagaatatgtagattaaatagacgcctaagaaaatttggtattaatgaacaaattatatccaatttagataaatttcatttaatgaataaaatcattgaagaaaataaaattgaaaaatttaaagatttttttaaataagattgttatattaatcataatataatttgaactcatttaatgaaataataaaagcgccgattcagacacttttcatataaataataatttattcattattatttatgattattcttcttctggagtgtaattccaaccggacgagccaccaaaagtagcaccaccgtaaccactactttgagtgcctagcgttcctgaagatttagcgccaacaccaagtgctccttgtacttttcctgcgtcatttaaaggagctaatcctttagtatttctcatttgttgcttaaagctccaggtaacatcagtgataatcatacttttcttaagtgtatcaatgtcattcatgtacattcgcaatgaatatggaatggtaaaatcttctgtataatttacagaaaatacattctttctttgaaaaacagagctacctgcgtatttaagtgctttgacagagtgagttgtacagttaactccagttacatcataagtatcaattatttttccaaatctctgggtggattcagacacagatgtaccacctatgtttttacccgtatgccatagacttttaaaatatcccattattgcaaaaatatcggcgtctctaatgttataaacttgagcttccattctataaagttcggttgacatatattcaattgcttcattattctgtaaccaaattaaaacaccatcgccagttagtcctaatggcccggtatcagcataacgaccataggtaaatacacttattccactttcggcatgaacggaaataaatgtatggcctgtaccctttgtttctacccataaaaaaatacccttaggtagccatcgacaagtcgtgtcatacatatttaatgtatgagagtcgagtttgtctaaaatccttgattgtctgatgacatccctattgttcatttgttttttatccttgcaagaatataaataataatcattgagacaggaaataaaattaatatcaaatgtatatcatggtttttaatgaatttaaaaaagatagaaaaatttaaggcgtaaataaacgtagagatgttatttagtaaggtaattaaaaagacagaaaaaatcattcgtaaactgtatcttagtttatttcttaaaaaaaatattgtagtgcacaaaacaaatagaaaattgttagtcagcattacataatcggtaatctgaataaaaaaagacaattcagatggggtgtattccttatttgtccatagagttattatttcttttatagttaaatcaatagaaataaatcctatattgctaaaaacaaataaaattattattatcagcatattaaacaatgacttaatccacatttattccccttatcatttttgtcaattcgaaaaccaaccacagctagaaaattctttattttacccatgataattgcacatttgtgatataccgccagacaggatataccagaattatttatacatcctagtataattgacaagaacgctgtaaaatcgtaattaatatcgtatattaaacaaataaatatagttacctgtgttacattttatttaagacgaccgattaaaaccacagaagtgtgaatataagcagctctaatattgttgctttctatatggcttagctggcgctcgatagcatcatcactccacaggcctgattcgcccattgcaccgcatgccattgtgcggaatccgtgcccacaaattctgtattggtgtcatagcccatagcacgcaaagcattatttacggtgttttcactcataactttctttggatcgtgatcgccgggaaacatcacctctccttctccactcagactgtgtaaggttttgataagcgaaatagcctgacggctcaacggtacaatgtgttccgttttcattttcataccacgttgggaatgcttaacctcttcaatgggttttctggttgcaggtatgtgccaaacagccccttcaatatctatctctcccccaacgggtaaacctcatctcactggaacgaacaaacgttaataaagtcagttctaccgcgattcgggtaattaaacgctcacggtaacaagaaagacgcatcaaaaactcaggtaaacgttcatggggtaatgcggcgtgatgtttagattttactatggtgagagcaccaaccgtatcattggcaggactatattcaagaatgtcattttggacggcataacgcatgatggcagtaacacgttgttgtaatctttgaactacgtcgtgcttaccgtcggtgtcaacagctttgataggctctaacagttgtctggttcgcaaagtacgtacatcaagcgtaccgatatagggggaaatgtattgtttgagatttcgcataatcctatctcgatggctttcactccaccgtttattgcttgagtactatggcaatctgttcaaaggcatatgcgccctttgattcggcttgtgcgtcttttttctctgctttgggatcaatcccttgagcaagcaattttttagcttcatcccgtttagcgcgtgcatcagctaatgagactgcaggataaacaccaaaagccagtcgatcttcttttttatcggtagggtggtggtatttcatgcgccagtatttcgaaccgcgcggcgtgatttcgagatataagccagctccacccgctaatttataggatgtctctttagatttcgcagtctcgatttgtcgggcgtttagtttcatttttggggcacatttaaaatcaaagtgaaggatgcccccaattatgccctctactgaagtagcatatagattgcaatggacgtaagttgagtgaaaacgcgagtaagggattgcagaatggggatttcagacataaaaaaagacgccttttagcgtctaaatttatatggtgccgaaggccggaatcgaaccggcacacccgaaggcggttgattttgaatcaactgcgtctaccgatttcgccacttcggcactgaagtattcgagaagtactcggaaaacggaggccattatacctgtcagaagtccattcgcaacacttatcctttcaatcttgttcaagtgccgaaaaaaaaagcacatctaatcctttcccatcaaaaacgctcaaaacccgaccaccttcctttcaaccagcacaaatcactcgcccataatccccgtctaccaatagacaacctttaaacaccttatataattccacaacaacataccgctctgaggtaaacaatcatgtctattatcggctatatttttataggtatccttgtgggtatcattattggcgctgtcatcgcgctgtttaagaaaaagaaataacgacgttgttccaattaaacgctccctgattggttaatccaaaaaatgaacaaacagttatataaactttttgctgtttcagccctgtcatgggcgctttcggcttgtgctgcccccgataatgcacaccagaataattttccgcaatcaggcaaaaaacccgcaaagtggcaagtttttgagggtgatgataataccaagaaaatggcctcatctctggtcgaccagtatgcgcagtcaatctttgatgaaggtaatccgttggggatggcgatggtgattatcgataataatcaggtggtgcatcgcagtttcggggagacttatccagggagtggagcccgtccgcgtcaggattcggtgatccgccttgcttcgataacgaaactgatgaccagcgaggttatgattaagctggcgcagaaggaacgcctcaaaatcaccgatccgttgcagaagtacacttattatggtgtgcgtgtaccagattatgcgatggctcaaccgatccgtctgtatcacctggccagccataccagcgggctgccacgagagcagccgggtggaaaatgggggcggccggtgtttatctggccaacacaatcaaatcgctgggcttggctgaaaacagcaggtatgaatgccgctcccggtacaacggcttcgtattccaatctggcttacgatttactggcggatgcgctctctaaagccacgggggaaccctatacccgtctgctacaagaagaaatcacccgtccttatcgcatgaaggatacgacgctgacgccctctcgttcccaatgtgctcgtttaatggaaggggttaaacccagtccctgtctcagcactaccgcagcagcaggcagtggcgggatttattcgactcccgtagatatgcaacgctggatgcagcagtttttatcctcccacaatcagttgaggaagaagactgccagccgtgagcagggtatctattttaaacgtgaaaatctgacgtcaatcacaggaatggatgtcgcgggtcaagcagacgggatcgggctgggctgggtatatatggatgccaaaaaaggggtgccgggcatctatcagaaaaccggcggtggcggcggattcaatacctatatggccatgatccctgagcagaatatcggtgtgtttgtggtgatgacgcgcaaggaacaaagcaaattcagccgtgtcactaacggggtgaatgaactggtcgcagcattatcacgaaatcatgggaagttatagttctatcgtgaatatcgtgtgttagaggcatgttcttgaaaaatcacagccagagatttgtaggtataaagctcaggctgtgatttgtgatgagcgttattttcgatgcagaaggaagtaaacactcacgacgaagaataacagacttggcagcagcgctcccaatagcggaggcatactgtaaaccaagctcaatgggccaaatatctcattcaagacataaaatatgaagcctgtactgatacccgcaattaccctgactcccattgccacactgcgcagtggcccaaagataaaggaaagtgccatcagcatcatgaccgcaacagacagaggggcaaagactttcttccacatattgagctggtaacgaccggcatcttgttgcccctgcttcaggtaagtaatgtactgctgaagcccgcgaatggagagtgcatccggatcaagagcgactacgcccagtttttccggtgtcagcaagcttttccattcagcagaaatacgctgtgaaccagtgatccggccaatctgacgtaaatcagactcctcaacctgagataatttccactgcctgttattttggtcatacaccgcagtagccgcatattttactgacagcagttttttgttgtcatcaaaatgatagatactgacgtctttcagggcattatccttgtctacactcttaatatagacaaaatcattaccatctttcgcccacatccctttggcggtggacatcagggaaccaccaaacatcttctgggaacggtagttacgggcgatctgttccccctgtggggcgacccattcaccgatcaccattgtcagcaataccaacgggatcgcggttttcatgactgaacccgctacttgcaggcgagtaaaaccagaagcctgcataaccaccagctcactgcgcgttgccagcatccccagacccaataatcccccaagcagcgccgccatcgggaagaagatctggatatctttgggaatactcagcagcgtatagataccagcggcaaacgcgctatattccccctgcccaaccttgcgaagctgatcgacaaacttgatgatgccggaaagcgacaccagcgtgaatagcgtcatcaaaatggtttgcaggatagtccgcccaatatatctgtccagtaccccaaacatcaggccgctccttgattcttaaagcgagaacgcagtttgcgcatgggtacggtatcccacatattgagcgccagcgccaaggcaaaataggctccgttgaccagccacatccagaatgcagggtcgagtttacccctgccaccattggagcgcagggaactttgcagcaggaagaaaatcaggtaaagcagcatggcaggcagcatactgagcacacgcccctgacgcgggttcacggcactcaatggaaccaccataagcgccatgaccagcaccgacacaatcaaggtcaagcgccagtgcagctctgcacgggaatcttcgtcacccttgtgccagagttgggagagtgtcttctgctcaactttatcgctatcaatatcagcggctttgtgcccaatcaccgcctgataatttttgaaatcggtaatgcggaagtcacgcatcagtgcagtgccttcataacgcatcccctgatggagtaccgcgacctgattaccattcggacgctcttccatatggccgccatccgcaatcaccacggaaggacgctgattattcaccggacggagctgggcaaggaacacattctcaaaattattgcccttgacgttaccgatatacagcaccatgttgccatcacgggaaggcttgaactgaccttccatcatggccgcaagacttgggttggcttttgcatccgccaatacttgctcttggtatttagaagaccacggagtgaaccagagaacgttagccgccgccagcatcgatgtgaacagggccagaatcaaggccgattttaccaacacacctttgcccaacccacaggcatgcatgacggtaatttcactttcggtatagagtttgctgaacgtcattaataccccaagaaacagactcaggggtaaaataagctgcgccatttccggcacacctaaacctaacaaggatagaaccaaatttgcgggaacacttccttctaccgccgcccccaatacttcaactaatttttggctgaagaagatcagcaataagatgaaaagtattgcgatttggcttttcagagtttcccgtactagatatctaatgatgatcacgcttattacgcctgtgaaaacttgtctttttgcaggaaagtcgctaacttcgtcgtatatctaccatttatatgcatcagtttggcttccccattgctaaaatgataccaaagcatcccatatattggttcccaattagaacacacttatcgttagctaagtaccaaaaaataatgtggtgagcttaacataacagtgaattttctttgggatgaattaatgcgcaacgtgatattttagcgattgtatccgtctttgtctttaagattcaggagaacgcatggagtttagtgtaaaaagcggtagtccggagaaacagcgcagtgcgtgtattattgtcggcgtgtttgaacctcgtcgtctttcccctatcgcagagcaacttgacaaaataagtaacggttatatcagtgccttactacgccgtggtgaacttgaaggcaaagtgggtcaatccctgttgcttcatcatgttcctaatgtgctgtctgagcgtattttgctggttggttgcggaaaagagcgtgagctggatgaacgccagtataagcagattatccagaaaaccatcagtaccctcaatgagaccggctctatggaagcggtctgtttcctgacggaattacacgtcaagggacgtaataactactggaaagtgcgtcaagcggtcgaaacagcaaaagaatcactctatgttttcgatcagcttaaaagcagcaaaaacgaactgcgccgtccattacgtaagatagtgttcaatgtgccaacccgccgtgaattaaccagcggcgaacgcgccattcagcatggccttgccattgcatcgggtatcaaagcgtcgaaagatctggcaaacatgccgccgaatatctgtaatgccgcgtatctggcatcacaggcgcgccagcttgctgacactgccgacaatctgaataccaaggtgattggcgaagagcagatgaaagagctgggcatgaattcctatctggcggtcggtcaaggttcccagaatgaatccctgatgtccgtgatcgagtataaaggcagcaaagacgccaatgcgaaacccatcgtactggtgggcaaagggctgactttcgatgccggcggtatttctctcaaaccaggcgaaggcatggatgagatgaagtatgacatgtgtggcgcagcttctgtttatggtgtcatgcgggttatcgcagaactgcaactgccgctcaatgttattggtgtattagcaggatgcgaaaatatgccgggtgggcgcgcctaccgtccgggagatattttaaccaccatgtccggccagacggttgaagtcctgaacaccgatgcagaaggccgactggtcctgtgtgacgtgttgacctacgttgagcgtttcgatccagaactggttattgatgtggctaccttgactggcgcttgtgtcgttgcgctgggcagtcactataccgggctgatgtccaaccataacccgctggcgcatgaattgctgaatgcctcagaactggctggagatcgtgcatggcgcctgccgatggctgacgaatatttcgagcagctcgattccaattttgcagatatggcaaacattggtgggcgtgcaggcgggacgattaccgcaggctgtttcctgtcccgctttgcgaccaaatacaattgggcgcatctggatattgcaggcacagcatggcgttcaggtaaagccaaaggagcaacaggtcgtccggttgcgctcttagcacaattcctgttaaatcgtgcaggcctgaatgcggatgattaatacccctgccccctttttgttgcctaacagttcgacataaaaggtgtagtctaaagatatcaagggaatcaacggaattaagggtattgcggctgcaatacccttttgtatcgcttttcccatcatttttctgtaacccatcctctgtaatcatgagactatgaaaaacgccaccttctatttattggaaaagctctcacaggaacaatcatcgtcttctgatgaattacagccacatgaatggctggcatgccagcttgccgctgatcaatggcgggcagggaagcgggttctgattgcttgcgaaagccagcagcaggccgaaaaactggacgaagcattatggcagcgggagccgagtcaatttgtaccgcacaaccttgccggagaaggccctcgttatggtgcccctgtggagttgtgctggccgcagaaaagaagcaatgttccccgcgatattctggtaacactgcttcctcactttgcagactttgccacagctttccatgaagtgatagacttcgtccctattgatgaaaatctgaaacagttagcgcgcgaacgatataaagtttatcgtagcgtcagctttaatttgaccatggcaacgccgccaatctattgaatatcaagataaaatggaaaaaacactcgctaatcaaacgcaatctgagccatctctcgataaaacctataatccgacagagatagagcaacctctttataaccactgggaaaagaacggttatttcaaaccgaatggcgataccagccgtgaaagtttctgcatcgtcattcctccgccaaacgtcactggcagcctgcatatggggcatgccttccaacagaccatcatggataccatggtgcgttatcagcgcatgcagggcaaaaataccttgtggcaagcagggactgaccacgcaggtatcgcaacgcagatggtcgttgagcgcaaaatcgcggccgaagaaggtaaaacccgccacgattatggccgtgacgcctttatcgacaaaatttggcaatggaaagcggaatcgggtggcaatattaccaaccagatgcgccgtctgggcaactccgtggattgggagcgtgagcgcttcaccatggatgaaggcctgtcaaaagcggtcaaagaagcctttgtccgtctgtatcaggaagacctgatttaccgtggcaaacgtctggttaactgggatccgaaactgcgcaccgccatttctgacttggaagtcgaaaaccgcgaagtgaagggttccatgtggcacctgcgctacccgctggctgatggcaccagaactgccgaaggcaaagattatctgattgtcgccacaactcgtccagaaaccctgctgggggataccggcgttgccgttaacccagaagatccgcgttataaagatctgattggcaaagagatcatcctgcctctgatgaaccgtcgcattcctatcttaggcgatgaacatgcggatatggagaaaggcaccggctgcgtgaaaatcacgccagcgcacgatttcaatgactatgaagtcggtaagcgtcacagcctgccaatgatcaatattctgacatttgacggcgatatccgtgacgaagcggaaattttcgataccaatggcgaagcctctgacgtttattctgctgacattcctgccgcataccgtggcatggagcgtttcgctgcccgtaaagcgattgtggccgaatttgaaaaacagggtctgctggtagaaaccaagcctcatgacctgactgtaccttacggcgaccgtggcggcgtggtgattgagccaatgctgactgaccaatggtatgtccgcactgctccgctggcaaaagtggcgcttgaagccgttgaaaatggcgatatccagttcgtgccaaaacagtacgagaacatgtactactcctggatgcgcgatattcaggattggtgtatctctcgtcaattatggtggggtcatcgtattcctgcatggtacgatactcaaggcaacgtctatgttggccgcgatgaagaagaagttcgccgtgaaaacaatctgggtgcggatattgccctgacccaggacgaagacgtactggatacttggttctcctctggcctgtggacattctccaccctcggctggcctgagcagaccgaagccctgaaaaccttccatccgaccaatgtactggtcagtggcttcgacattatcttcttctggattgcccgcatgatcatgatgaccatgcatttcatcaaagatgaaaacggtaagccgcaagttccgttcaaaaccgtgtacatgaccggcctgattcgtgatgacgaaggccagaagatgtcaaaatccaaagggaacgttatcgatccgctagatatgatcgacggtatttcgctggaaaatttgctggaaaaacgtaccggcaacatgatgcagccacaactggccgagaaaatcggcaaacgtacggaaaaacagttcccggaaggcatcgaagcccacggtactgacgccctgcgtttcacactggcggcactggcttctaccggacgtgatatcaactgggacatgaagcgcctgcaaggttatcgcaacttctgtaacaagttgtggaacgccagccgtttcgtgctgatgaatactgaagggcaggattgcggtcaaaatggcggagaaatgtccctgtcactggccgatcgctggattctggctgaattcaaccagaccgtgaaaacctaccgtgaagcgctggatacctaccgttttgacattgccgccaacattctttacgaattcacatggaaccaattctgtgactggtatctggaactgtcaaaaccggctatcaacaaaggctcagaggcagaagtccgtgcggctcgccatacgctgattgaagtcttagaaggcctgctgcgtctggcgcatcccatcattccatttatcaccgaaaccatctggcagcgcgtgaaagtggtgaaaggcattaatgcagataccatcatgctgcaacccttccctcaatttgatcaggcgaaagtggacgagctggcgctgagcgatctggaatggatcaaagaagccatcattgcggtacgtaacattcgtgcagaaatgaacatcgcgccaagcaagccgctggaggttctgctgcgtgatgccaatgcggatgcacagcgccgtgtggctgaaaacctcaacttcattcaggcgatgggtcgtctttcttccgtcaccgttctggcggtgggcgaagaagcccctgtttctgtcaccaagctgatcaacggtgcagaaatactgatcccaatggccggtctgatcgataaagacgttgaactggcacgtttggataaagaaatcgagaagctggataaagaaatcagcgcgattgaagccaaactgtctaacgacggttttgtcagccgtgcgccggaggccgttgttgccaaagagcgtgagcgtctggcaagcaacaatgcggcaaaagagaaattactggcacagaaagagacgattgctgcgctgtaatctttcttgattgaacttcattcaagttaagccactgcatttaatattgcagtggtttttttcttttcacaaactgtattaacgcaacagccaatgaataacaataaaaaataccagcgaaaaaaacaggatttttaatattgaacacgtatgcttgctgataaaataggccaatccaaccgtgactaaagcaattaaatatttaatatcaaaattatgaattaattcactcagggataaattatcagtaattatatagaaaatatcacatacacaatatcatataacattatcttctatgcaatgcctttgtcattgacgttatattgggaataattccaaaaaccataattccctcttggagaagtataatgaaaatcgtactcaacatactactggcaactatcatccaattaggcatcacccaactagcgtatgcaaaatccacccttgataatatccaatccacaggcgtattcagaatcgggacagaaggagcctatgcaccattcagttaccatgatgcttccggcaaattaaccggttttgatgtggaaattggccgcgaaattgctctgcgtatgaaagtaaagcctgaatttattgaaggtaagtgggatggtttgattggtggccttgatgccggacgttccgatgcagtaatgaaccaaatcgccattacgccagagcgtgcgaaaaaataccgcttttccctgccctatgtcatttcagaggcggtgctgattacccgaaaagataatcatgacattaaaactttcagtgatttaaaaggcagaacctccgcccataccctgactaataactttgcccagattgcccgccattacggtgcagaaattatcggcaccaatggctttagtcaggaagtggaactggtcagcacaggccgggcagatgccactatcaacgataaactctcttatctcgactataaaaaacatcgcccggatgcacaggtaaaaattgtggcggccgataccaacgcagcacaaaccgccgtgctgctgcgtaagagtgatcctgaattaaaagcggccgttgataaagcgattactgaaattaaaaacgatggcacttatcagcggatttgggataactattttggcggagaggtggctgaataatcagaataagattatgggtgtttttttaattattcatagcccattgaaattaaaaaacacttttaatctcgattttcttacaggatctatcatttaatcaagttacatataataaaaacaccaaataaaatcatcacctttatattatgttaaccccaccctcaacaacacatagataaaatagataaataaatacataaatacataaatacataaatacataaatacataaatacataaatactcaaaaataaattatttaaatatatcatcttacatatctaatatctaatatctaatatctaatatctaatatctaatatctaatatctaatatctaatatctaatatctaatatctaataattaattgatatttatatcaaaattattttcacatttctaatcaaggaaacattataaataaatttggatattattccaaacagattactgacaggcaccatcggcgcctgtcaaataattattttcgctagattagactaataatttcatcatttaaattttacatttctatatttctatatttctatatttctatatttctatatttctatatttctatatttctatatttctatatttctatatatataaaatatttttcttatttatataaatcatactaatttttgttatccctgatattttataaataaaaaaacatatcatcacaataggcattattaacttagccatatctcaaactgcaacaacaagctctataaaaagcgtctgccataatcgatgaacttatcatttttatcaatatcactgacttactcttggttctaagctataactttattttatataaagatggcattgtcttgccatatcatcattaaaagaactatgcaaaaaataaagactttttgaacaacaacctatctctgtagctaaacccgctattctgatcagataggctctgatatgttgtataaatatgtctctccaccctataaataggaagaatatatgactccatcatggctcagtttagcgctggattccctttggccgatgctttacgctggcctgacatttaccattcccctcacgctgattacattcgcacttgggatttctctggggtttatcgtcgccttaatccggctgtacgggccaaaaccactgatcgcagtcgttcggttttatgtctggctgatccgtggtacacctttactggttcaactgtttctgatcttttatgccctgcccagcgtgggcattacgctggaagccttcacctctgccgtcatcggctttaccctgaatgtcggtgcttatacttctgaagtgatccgggcagcgctgatttcggtgcctaaagggcagtgggaagcgtctcactccatcggcatgagttggtggcagtcactgcgccggatcgtactgccacaggcggcgcgagtttctattccaccgctgtcaaatacctttatttcattggtgaaagatacctcactagcttccgtcatcactgttccagagatgttcctggctgcacaacgtatcgccgctgtcacataccaaccgctgatcctgtataccgaagccgctatcctctatttgcttttaagttcagtgctgtcagcactacaagttcgtctggaaaagaaattctcccaacaattttcccaacaccgcagcagtaaggaagcgaaaaatgattcagctctctaacattgaaaaaagtttcgacggacaaaaggtgctgaaaaacattagcttgaccattaaagaaggtagcctgacggcattgatcgggccttctggcagcgggaaaagtaccctgctacgctgcatcaatctgttggagatcccacaggcgggtacattggaaattggcaaagaacagatagccttcaccggcaaagaacgcctgccacacagggaaatccaacggtttagcctgcaaacgggcatggtattccagaattttcagcttttccctcatctcacggtgattgaaaacatcatggaagggctgatttatgtacaaaaatggccacgcgaacgcgccagagaacgagcgcaggaattactgaaaaaagtggacatgttccataaggcagatgtctggccgaacacattatccggtggtcaacaacagcgtgtggctattgccagagcgatggctccctctcccaaagtgctgctctgtgatgagccgacttcagcccttgaccctgaattatcgaaagaagtcgtttctgttctgaagcatttggcagaagaaggcacgaccatggtgatggcaacacacgatctgcgtctggccgccaatcttgcccacaatgtcatctttctggaatcaggcgaaattgtcgaatcgggaacagcacaaaccatgtttacccgcccggataagcagcgcactggcgagtttatctcaaccctgacggaaactttacctgactgggaaatataacgggctgtgacgtttagactcagcgtaaacccgctaagacaaaataagcatagtgacacattattgatttggagaaatacaatgaaagcattcctgagtttgttactggcgggcgccacagccctttcaatctctgcgcccagttatgccggaaaggatttggacacgataaaagcctccggtgtctttaaagttggaacagaagggacataccctccttttacctatcacgatcaggccaataaattaactggttttgatgtagatatcgcccgtgaagttgcacgccgcctgaatgtcaaaccagaattcatggaagttaaatgggatggcttgattgcgggactggatgccaaacgttttgatgctgtgatcaaccaagtgggtgtcacacctgaacgggaagcgaagtacagtttctccattccttataccgcttcccaagtcgtattgattactcgcgataataacaatgacattaaaaccttcgctgatatcaaaggaaaacgttcagcccagtccctgaccagcaactatgggcaactagcaacctataatggggctcatttagtcagtaccgatggctttaaccaagccattgatttggtcgctacgggtcgtgcagatgcgacattaaatgatcgcctttcgtttctggatttcaaaaaacagcgtcctgatgcaccagtgaaaatcgtcgctcaacaagccgatgcaagcaaatcggccgttctgctccgtaaaggagatccagaactgatcgccgtcatcaataaggcactgcaagacatgaaagatgacgggacttatgcccgtatttccgaaaaatacttcggcactgatatttctaaataacctccccctcaattcctcaatcagcggcgttttcatcacgccgcccattaatagattcagcaagtttatcctgtttacttatttgttttttcaattaatatcaagctgatagtgacttacgaagttaactctatcctcaagtgtggctccaatcactttatcctccttgagtcgtatctccccccaacaaactgcctgtttcgggagaattttaagtcaaaataaaaaatataaagaggaaataatgactgaaaaaacaacacaacactacgtcattcgccccattactccgcaagataataccggcattgctgccgttatccgtcaagtatccgccgaacatggcttaaccgcagaccgaggttttgccgtcgcagatcctattctggatacattgtacgaagtatacagccagccacgcagcgcttactgggtcgtcgaaatggatggggaagtcgttggcggcggaggtgttgctccactagctggcggcgatgatgatacctgcgagttgcagaaaatgtatctctcatcagtactgcggggaaaaggcgttgccagacaaatcgtgaaacaatcactggaatttggcaccgagcaaggcttcaagcgctgctatctggaaaccacggagatcttgcaagcggccatcaaactgtatgaaaaactgggattcagctatcttggtgagccactcggcaatactggccacagcgactgtgaggtcaggatgatcaaagcactataatgcatctaatcagtcagccccacagaccaagtggggcatttatttcgacaatctcgtcagaagaacttagtgaagtttgcgctcgtcctgctcagggaaattttcagcttcagcttcgtcttcatcctcatcatctggcgcgttgggatcttcaaaatacgtcccccaaccatcgtaattcacaccgagcttttcaaccagattcatgagttgctcaacctgcgtattaatcagttcagcatccagacggctttcactgatgatatcacagcacatcagcacaacacgatcttcagtttccagctcttccgcatccgtcacttcataaccgagtttgaatgcttcaacggcggctttttccaaaagatcgaagttttccgccgaaaaatggtgctcaataatataaagcgcatcaggatcgctgccatcttccaataattcttcaatgatcaagcgagtttcttcgcgctgttcttctaaagcatgtgggtctgccatgccaatcccctccgtcatttggctgtcctgttgcgcattctcccatctttttcctgcgaaggatatagctatccaatttcatcaaaaaggaaatacagaccgtaaactatggcatgaaaaattgtcttgatttcattgagatgacaaatacacatcacaggggttgtaattgaattttttatcgatatatattgaatataaattcaatatcactctaatggagaaaatacagtatgaatccattttatcaacgtaacttattaagattacatgactatactccttcagaaatcaatacctttctgacactggcgagtgaattaaaaacgaataagaaatcaggtaaagagtcgcctttactgtcaggtaaaaacatcgcgctgatttttgagaaagactccacccgtacacgctgtgcctttgaagtcgctgctcatgatcagggtgccagcgtcacctatttaagttcaaatggcagccagattggatataaagaatccatcaaggacaccgcacgggtacttgggcgtctgtatgacggcattcagtaccgtggatacggtcaggaagttgtcgaaactctggcgaaatacgccggcgttccggtctggaatggtttgacgaatgaattccacccgactcaactgttagccgatttactgacgatgcaggaacatagccagaagccactgactgaaatcaaattcgcctatttgggcgatgcccgcaataacatgggcaatacgatgctggaagccgctgcattaaccggtatggatctgcgtctggtcgctcccaaagcgtgctggccggatgcggcattgattgccgaatgcgaaaccctggcagaaaaaaccggcggcaggatcgccctgacagaaaacattgccgccggcgttaaagatgccgattttctttacactgatgtttgggtttcgatgggggaacccaaaacagtctggcaagagcgcattacgctgctaaagccctatcaagtgaatatggatgtcattcaactgacgggtaacccagaggtgaagttcctccactgccttcctgcgttccacgatgaagaaacaacgcttggcaaacaactggctgaggagttcaatctgtatggtgggctggaagtcactagtgaggtctttgaatcaaaacacagtattgtgtttgatcaagcagaaaaccgtatgcacacgattaaggcagtgatggtagcaacgctagcgaagggacttagtttttgatgggtgttaatgcggtgcgaatgagcaccgctttttgttttttcaaggtatagacgacttattgggtagtatccaagtatcctcagaagacagcgtgagtgcagaacatcgttgtgcgtaacgaatgctgtcttccagagacatactctgtaaccaacagtgggcgagacctgccatcatcgcatcaccagctccactggcattgagtacactggtggtaatcgcacgtgaatagcctgatttattatctagttcactgtagtacacaccttccgcacccatgcttaaaattaaacgttgaacaccttgttgatggaaccaggatgcggcgacagccgcatctttttgggtctcaatttctattccgctaagaatttcagcttcagatcgattgggtttcagggtgtggatatgagatagccaatggcggatcttagtcgccttaaatgtggaaacggtatcaataaaaatcggcacatttccagcatgattaaatagccattccaatgatccttctgtcagattacagtcaatgaccagtacactagcacgtcggattaattcttcggactgagataataatgtgggcgtgagcttttccataatgtccatgtcattaacagagactatgcatttgccattttcatcaatgatagaattgcagattgatgttttttcctcatctaatttatggaaatatctaatattaaccccagctaatttcgtttgttcgaataataccttgccattataatcattgccaacaacagaaatgaaatggctttcacttttcagtgcagcaatattttgtgcaatatttcttccgacacctcccggcgtcgatattattttccctgggttggaatcttcatacactagcttttcagaggcataactggtgaaatccatattggctgcgccaattgtgacagcataagcattattagaactaggaaaaatatatcctttgccctttatatgaccttttttgttcatattcataatgtgtcctgctacacatgaacgactaaccccaagaatatcagcaatttcttgttgctgaataaaaggatcttgcttgataagtcgtaatatctggttttccctgcttggcatatcatgcccctgattatttttttagtgttaatatttttatttcatttttgacaatcagtaaagattatttttatattccgttcttattatgcggaagtgatcgtaatttttataagatgtattttgtggtataaatcgtgatttcagtcacaagtattattctgtaaaattaacaaaaatcagcatgataaaaagattgatctaggttattatattttattctaaaattattatattaataacaatatgttatgttagataaatatatcaacaaacaaatgtttatttttcattggaattgattttttctcgaataaatgagtgtttattataccagaaataaggtattttttggattgcggcagaatgccgtctttgtgacatttattggaaaagcaagaaaaattgttctgttcagtaaaaactgaacacttttcctgccacaggatgagtacgtactacagggtgcaataatggtggatttttacgtgttgcctgtaaccagcgctgatgttcttcctctgtattgcgataacgatactcagggaatgctttggtaaaagcatgttcggcttctagccctgccagcaacacttttaaaggttcagaaaatgaattggattcaataaacaacccttattgaaaaagacaaaaaaattcttatagagaacatatagggaggtttcaacacgttcttttggcatggcaacgaaattaggttaactaaattgctgaataagcatattgcgaatgataattctgatttgtttcaattttatttaaaaataatctctaacgaaatgttaaattacaccatgaaatagaactggtcactgcgctacgttctttttagagcgttattttttaaataactattttcaataaaattatcaacctttaaattaaaaaataaaaaggctaaataaacaatagattaatttataaaattgaataattaagctgcgtaattttactttttgtaaagaaattctatattctggagaaaaataaaaatgaaaccaagcataataatcatagctgaatctatattaaccattccgttcgtatcattacatgccaataccaacgccaagaccaaggccaatgtgaaaattactgattgtaatcaattaaatggaaaacctggtcaggatggtaaaaacgggatacctaatagcaactgtataaatggaggtaacggcagtaacggctcatctcccggtcaatcagaaggaaatggtggcaacggtgcaaacggttcatcgagtgagcaaactcaaggaaatggtggagatggaggcaaagtatccaattatcacaatctccaacatgcaggccgccatgcttaaaaccaatacgtatacctggaatcattataagcaaaagagcggaaacgatgaatgccagcagagcatcagtaaccaacatggtaatctccgaaaataaaaatctaattgaagcttatatatttgaccgacaccgattttgtcaatcaaacgccattatctgcctgatggaatttaaagctctgttcatgcattaactgggcgttaatttttagggtacccggcttgccatgacgctgcccgactttaatggctgtggcttcatctgccgataaatgcacgtaatggcgcaaacctgccaccaatccctgctggaaaatagaatccagaaaacgggggctgtaccgtgatacaaaaccgccggcgggacttgcgcttgataactaatatcgaccttttggcctgaatgcccctgtaccggagagcataataaagtgccccacattttatgctctccattatagatagttatgtggatcttgcgtctgatgcaacaccgccaacacttcaataccagtcggaacttcccggtagtaaataatgtggctctctacggggaaacttagcacaccaaaataaagatcctcactgcgatcacgaccgggggatgggtgacgatcaagaattgccgtcatagtcacacgcaacgaagttgcataagcttccgcgacattcaccccccatcggcgcatagaatagagctttactgcacgaatatgctctctggccttcttagtaaaccggacactcatccctaagccttaccctcaagttcatcaaccgtcaacggggcaaatacatcatcaatactatgcaattcgccacgatcagcttgtgcaatagattcagccagaacggcttttaaattctgtaacttgagctgtgtgaactgatcatactcttcaggagagataaccacggccacacgcttaccatgtttactaatttccacaggctcacgctgaactttcataagcagatcaccaaactggttcttagctagttgtgcgggaataatttccatacatcacctaccgtctaaaatggctcgaatagctattatagctaaaagtgcatagagctaccagtaatcaaaatagccaaccgccaaccagctggtcgagtagcccgagaggatctcacccacaggctactcgaccaggtattgagtgtcattttcagaaaacgattgcacgaaatgtcaggagtcggctgcactcgattgctggagttgtggagcaaatagctgacccgattttgggaggtaggagtttcaggagcaacggaacagtaaaggtgctcatcgaacttgatgtgatattacaaggacccaaaatcggacgtagtcacagttaccgtttaaaccctcagttcggctggaaaggtacggtaaataatcataaaaaagcgcttaccaatggcctgagtgtaattcagggcggccgtgcttaaaaaagttaaaaccgcctactcaggcggctttaacttagagttttagacatattaaacccagtgatatgaaaaccacttttttcgtatagtgctttagcaactggattattgggagcgactctcaaccctacctctgtgatgcccatagacatgagattacttttcattttatccagagccgccttacctaatcccttacgacgccactcgggtaataagcgaaaatcacaaacccacgcagctttctcttgaagttctatccatagataaccaatcactggcagctcatgatctgatttcacaatgcaccagaatttgtttattactttctctgttacttgggattgggttacatcaatcaactgagaggcttttttaagtgatacgtctgccggataacctcgtgttgaagctaagtctaatgcatgctcatttataaaaagtaaacggaataattcaaactcagcagttgtcatttctcttaattcaatcattttaactctttagataaaaaaataatttttccaaaatatcattaaaaaaagcatttacaagacttaatttatggggtgtttcatccttgaaaacccaaagtctattacctgccattactgaataagttaggttaaaccctacatacttggcccatagtcagggcctgatctcttccgtatttgtgcaggctccggtcgggctaatgcctctgcctgtaattggagtttcagcgcctgttctgcctgtagaaattcccgaactgctggagctgccccgacaattcgcttatccaattatcacaatctccaacatgcaggacgccatgcttaaaaccaataccgtatacctggaatcatcataaataaaagagcggcaacgatgaatgccagcagagcatcagtaaccaacatggtaatctccaaaaataagaatctaattgaagcttatatatttgaccggcaccgattttgtcaaccaaacgccattatctgcctgatggaatttaaagccctgttcatgcattaactgggcgttaatttttaggatacccggcttgccatgacgctgcccgactttaatggctgtggcttcatctgccgataaatgcacataatggcgcgagcctgccaccaatccctgctggaaaatcgaatccagaaaacgggtggctgtaccgtgatacaaaaccgccggcgggacttgcgcttggtaactaatattgaccttttggcttgaatgcccctgtaccgctctgattcgtttttgatcgtctgaaatggcaaatcgctttttatcattggcctcgacgatcgttgcgatcagcgcatgattcaagtgcttaccgtgcttctccgcacatttaatcagtacactgatatctgcccacccttcactatctagcgttaagccaatagattcaggttgatgacgcaacacataacttaaaaatttgcttatttttgtatcgaattgagccattttttacctattaatcttatatcttgattaaagatgtttctttatacgcgtttcatcacccaacgccttaaataatcatccagtagtgcatgactgcgttcacgcttatccttgagttcgcaacgagacaacgtttcatcaagttctgattcaataaaggcgtgaaccctcagcttacgcaggccatattctgcctcattcgctgatcttttaagccgcagtagatcaccaatttccgctttcaattgaggatcatcgactgtacctgccaccagcgtttcaaagtcaatcggtggtacgcccttgcccatttcgatccagcgtacagcaagcaacgggcgcaatacgtaaaaatattttttacgccgaattttttcaccttgcagataacctcggaagtttttcttcgccatcgaaaggtagtgatagcgcgctttgatatccgaaaagaaatgcggcaccatcgtttttaatccattagtggcggccggatctgctttataaataatcggcgaatccaaccattccattaacgttgggttcgcctgtttcagtaactttagtgtcttacgcagttcccatccgcagatatccagctcatcgctgatcggcagttcaatcacatcccgccctgcttctacggtgagataccagtccacgggatggacataaataaaccgcacatcgtaatcactgtcaggtgaggcaaagccccacccgcgactgccggattcacaggcgtacagtacccgcacgccataccttttctctatatccgccaattcctgtttaacgcgggtgcgcatggccgggctgaccgctgttgttttcctctccatgatttacattttcctatgactatttttatccttttacgcaaaccacctgacgcagggtatgcacaatttccaccagtgatgactgagcttccatcacagcatcaatatctttgtacgccattgggatctcatcaatcacatcgctgtctttacggcattccacatgcgcggttgcgcgcttttgatcgcttacggtgaaacgttttttcgcctcagtacggctcattacacgccccgctccgtggctgcatgaacagaaactttcttcgtttccgaggccacggacgatatagcttttcgcgcccattgaacccggaatgatccccatctggcctctacgggcagataccgcccctttacgtgtcaccaaaacctcttcaccataatgctgttcacgctggacgtagttatggtggcagttcacggcttcctcctgtgttgtaaacggttttgggatctcgcgtgacaaggcttcaagcacgcggtgcatcatcacttccctgttttggcgagcgtaatcctgtgcccaaccaaccgcttccatgtaatcatcaaaataacggctgccttcttcgaaataagctaaatcacggtctggcaggttcgcaatatgctgctgcatatctttctgcgccaatgaaataaataagttaccgatagcgttacccaccccacgggaaccgctatgcagcatcacccagacacgatctgtttcatcaaggcacaattcgatgaaatggttaccagttcccagtgttcccaaatgctgatggttattggtgttcagtaattttgggtatttatcggtaatacatttgaaaccatccgccaacgtcgcccaatgctgatccacaatttccggcgcacgatgccaagaacccttatcacgaccaccacggttcacagtacgcccatgtggtacagccgcttcgatggcatgacggatattcagcaaactatccggcaaatctgatgccaccagggaagtacgcacggcaatcattccacaaccgatatccacgccaaccgctgcgggtatgatggctccgcgtgttgggatcacgctaccgatagtcgatcctttaccgacatggacatccggcattaccgccagatgtttgaatacaaaaggcatcttggccgtgttctgtaattgggtaatggctttcggatcaaccgggactccgtgagtccacatttttatttgagtgccattttcttgcgtcaataagttataagcgttggttttcatttcagttgctgtcatttttgttctcctttgatttgtaccagcccattcagaacttgatctaagccgccatataccgaaatttgagtgattcgttcagcgatgctttccatcactttcgcggtattcaacagtaaacgggttcccacatacgagttattgccaattacgtgccaactttgaaaaaagcaggaatatttcttatctatttgaaaattaattatttttattttcacttgtttttggtgattgtttttacagtcagtttttcttatctttttatatcgttgtttataaaattagataatcgaatcacagggaagagcatgaaacgcagagttgtcattggggttttgggtacgaagttggatagacggggcaaaaaggccaaccgctggacaaaatggcgccctacgattggtatgtgccagcaagcggagttgccgattgacaggctggaactgctctaccaaaccaatgactatggtttagcacaaagagtgaaggaggatatcgcagagacttcgccaaaaacggaagtggtcttgcaggagcttaagattgaagacccgtgggattttgaagaagtctataccgcgcagcttgattttgccgtgcgttatccttttgatactgaaaacgaagaatatctggtacatatcacaacgggcacacacgtcgcccaaatttgctggtttttgctgaccgaagcccgttatctgcccgcccagttgctccagacctcccctagaaatagcgatcgcgagagccatcctgaaggcgtctacaccatcattgatttggatctcagccgctataccaccctgaccagccgctttttgcatgaacagcaagaacaggtcgcatttttgaaatcgggtatcgccacacgcaatgctaatttcaaccgtttgatcgaccaagttgaacgtgtcgccctgcgttcttccgcccccattttgctgatggggctaacgggcgcgggcaagtcttttctggctcgccggatctatcagttgcggcaatctcgccatttaattcaaggccgttttgtggaagtaaactgcgcgaccctgcgcggtgataatgcgatgtccacgctgtttggtcatgttaaaggggcgtttacgggtgccattcagccgcgtacagggctactgcgtgaagccgatggcggcattttgtttcttgacgaagtggcagaactggggttggatgagcaggctatgttgctgaaggccattgaagagaaaagcttcctgccttatggctctgataaagaagttcacagtgattttcagttaattgccggtactcaccgcgatctgcgcgattgggtggcacaagggaaatttcgtgaagatctgtacgcccgtatcaatatgtggacttatcaactccccggtctggcgcagcgtcgtgaagatattgagccgaacattgagtatgaacttgcccgctatgcacagatgcagcagacacaggttcgcttcgataaggaagcgcgactgatttacctgcatttttcctgttcagaacaggctcaatggcggggcaacttccgcgagttaggtgcatccgtcgcacgtatggcaacattcgccgaaaacggacgcatcaatcagcatttagttgaagaggaaattatgcggctcaaacagaattggcaggataataggctctcttccctgctgccgaatcatttgccggaagttgatctgtttgaccgccaacagttggaaacggtcattaaagtttgccgtgaatctgccagtttatccgaagcaggccgcaagctgttcgccgtttcccgccaacaaaagaagcagcccaatgatgccgatagattacgcaagtaccttgcccgattcggtctggactgggatagcattcaacatgattaggagaagaataaaatggaactgaaatttttaggcaccagcgcgggtgttccgacgaaagagcgcaatgtcaccagtctggttctggatttacggggtatccgcaatacactatggatgtttgattgtggtgagggaacacagcaccagatcctcaactcctccatcaagatcccgaaactggagaagatctttatcacccatctacatggcgatcatatctttggcctgccggggttactgtgcagccgttcgatgggcggctccaccgatcccgtgatgctatacgggccaaagggaatacggcagtttgtagaaaccgcattgcagttgagcggctccttcctcacttatccactggatattgtcgaagtgcaatccggactgctgtttgatgatggcgagttgaaagccacggcttacgcccttaaccatcgcgtggaatgctatggctatcgcattgaagaacatgacaaacccggtggtctggatacccagaaacttaatcaggataatattcctcgtggcccgtggatgcaggtcttaaaacaaggcggtacggtgacattagaagatggccgtacggtgtgtggcaaagattatctgggtgcgccgatttccggtaagtcgctggccattttcggcgatacgacaccaacccccgaagcactgaaactggcagccaatgttgatgtgatggtgcatgaaattactctggaagatgcacttgccgaaaaagccaatcacaatgggcattccaccacaaagcaagcggcgacactggcacgcgatgccaaagcaaaacactttattgcaacacatatcagcggacgttatggtatagaagattgcccgcgattattggcagaatgtcgggaaatattccccaataccgatctggcagaagactttgcgatatttatagtttaataaatcatcaatttgcacatttgatactcttatcaatatcaaatgtgtttacccgacagcgatacacagccttccttagattcagtctacgaataatatttaaaatagtagttacatattttaatatatctcattaactcattgttttataaaaacttaatttcaagatattcataatctattaaataataaaaccattttttatcattttattttttgtcaccatttttaggtgacatattaacatttttttaaccaatataatgcgcgcaatgacatcctcacttaacatgcgagcaacaaagctagcatttaggtagtgtcgcctattggtaggtaataaataaatatactgaaggaaattataaataaaaattaacattaaataaattaacaaccaaaataacgatgagaaaaacttggtaaataaattccaatttcttattggagcacaatttttaattaaaaaaccaaagggtcaataatgaattcaatcataaaaacagatattaaagaaagtatggctaatatttccacagaaaatacagttaatatctggtctgactggcttgatgaaaaagaattaaaaaaattgacagatcaccctgtactccagtcatttaatgacagtacagccagtgaagaaatgttaaaaacattcctaattcaacactgctattattctcgtcattttacacgttatttaatcgcgcttataagtaaattagacgtatttgaagatataaaagatcttcttcataatttactggaagaaatgggattagaggatgaaaacaagatcactcacgctgagctttttcagagaacattgaaaactgtcggtgctgatatcaatagtcaaaagccttttgaaaatacaaccgctatggttgacgctatgttttctttctgtctttcagatgatccattagagggtctgtcagccatgtgccttggcgctgaagctatcgttcccttaatttataagcccgtattaaatcgtttaatgacgttgaattacaataaaaatgcaacagaattcttcacactccatattgaagaagatgaagatcatgctattaaaatgtttgaaatcatagatagactcactagtcaggacgaatcattacgcctcaaagccatcaatattggcagtgaaatgataagaaatcgcgtaaaaatgctggatagtgtctgggagagtgaagtcgttcgtaagaacaacgcagaaaaggccgacttaaataatcaaaaaaatgatctttcctttcattctgctgatttttggcgtgtcaactacaaaccaacaccttctattcctgagaaattgattcataaagatgtcatcaacagtaatagtcatggtgaaaatcaattttcagcagaaagaaaacataaagtcaatatcgtcaatttgcctactaaaaccatcagtatgacattaggccatcttgacgccgaacaatcgacgaatctacatcgacataattatgaaactgtcatctatatcattgaaggaaatggcgtatcaaaaataggaaataatgatgttgcttggtcaggaggagatgctatttatatcccatcctgggtcgaacataaacatagtaatatgggtcaggataaatgcctttatattgcttgtgagaatgccccattattacaaaatattggtaacatcgcacttcgtgaagaattagaataattaatgaagaaggtgatttattatgtcattagccacatttcctacacttgaagctattgttagcacaactaaatcaataaatttagcgcaacgatttgttatggaaaactcatctcttgataaagattgttttatcggaccagacggctcattgagttattcccagcttgcattttttgtccaaaaaagtgcttctgctatgtcgttaaaaaaaatagaaaaaaatacagcagtcatcctctgtctcaatgacagccgggaattagctattattttctttgccagtttagcaattggagcgttaccggtcgttattaacccgaaattaccagctaatactcttaattacatactgggtgaatttgataccccctttattttcctcgatgagggtaatgaaatatctatcgcacctgaagcgaaagaaaatactatccgtattaaaaggagtgccgatctttcggcattctgtgattggatgcctgaaaacaccaatgataaatggcatgattttttggaaaaaacccatcttgagcctgctttcattcaatatacctcaggatcgactggaaaacccaagggagttattcacagcgttacatcaattttgtcttcctgtgaacatttttccaaacatcaattaggtttaactacaacagacattatctattcaacaccaaaaacattttttggttatggtatgggaaataccctatttttcccgctatatatcggtgccactgcaattatagacagcctttggccttcaataataagagttacgagcaatatcaaaaaatttcagccaacggttcttttggcggggccgatgatatttcgcttgttacttgaagatgctgaatttaaacaatattgccatcttcgcttggtcgtttcttctggctcaatgttacctgcaccgttaaaagaatcctggtttcagcggctcaatatcgtcatacatgatgcatttggcgcaactgaagcatgccatgcttttgcgacaacttatggccatccatctcgttcgggtagcattggaaaattgattaccgggtgtacaggaaagattgttgataaagatggaaaaaccgttccggctagggaaactggcgtgcttatgctgagttcagaatccttagccctgggatattggaataaccatcaagatacaaatatcaagttttccaacggttggtatcgcactggcgatctattttcgcaagacgaagaaggattcctttattatcacggccgtgaagatgaacagttcaaagtattggggcgctggttggtgccggtagaaatagaaaaactcgtccattccgctttcccagaaattggtgatgcatttatgatcccctgggtggatagcacccaagaatgcagacctgttttatgtctgaaaacttcttccagtgaatttgaagccatcagtcaacagatagccaattttatcagccaccaagtggaaagttataaacatccctatgtttatctcaacttagaacaattcccactgaatggaaacggtaaaattgaccgtaagtcgatgatcgaaatcgctcgccaaaaaattactgacgaaaatatgtcttctcatcctcggagaattaattatgcacaatcttaatgaatttcttgcttatggtgaagaaggatataatttggtgccagtatggaaaaatatcaaaaaaacacagatatctcctattagcatttacgaagccttagccaacaaaagctatagttatcttttcgaattatctgaaaaacatgaggataaatatagggcaacttattctattgttgggcttccatgccatcaacggatcgaaataaaagattattcaatcaaagtatttgacgagaataatactccgacttatataacagatattcccccgctggatgccctgcggcaaatactggcaagctatcgcgtgccaaaaattgatcaattacccaattatgctggtgggttgtttggttattttggctttgaaaccacacggcttatcgagcctaagctccaagccaatacacgtaaaaaaacattaattgatttaccggacatattacaaatagtcagtcaagaattgatcgttgtagatcatagaaatgatctcatctatgtcattgtccatgcaaaacctactgaatcccaaaattttgctgatgcaaatctaagaataaaccagattatcagtgaactggaaaagatcccccatcaacaacaggctaacttcagtccttctactaccaccgatagaacgacttggttcaaggacatggagtctcattttccacagcatgactttcaaatggccgtcaacaagatcaaggagtacatcaaggcaggtgatgccatgcaggttgttttatcccaagccatgtcacgaccattaaaggccaatgccatacagctttatcaagcactaaccagcatgacaaacacgccgtactgttatttgatgaatgtcgaagatagccatgttgttggcgcatcccctgaaatgatggtctccctgcatcaaaacaaattgatcagccatccgatggcaggaactcggcatcgtggcatgaaccagcaagaagatgatgcactgaaagccgagctacttgcagataataaagaaattgccgaacacattatgcttgtcgatctggcacgcaatgatattggacgcgtagctaaaacaggcagtgttacggtcaataacctgttaagtgttgagtatttctctcacgttatgcacattgtgtcggaagtatccggtgaaaaaatggatggtatcgatgaaatagacgtcatcagtagcacttttcctgcgggaacactcagtggagcacccaaaatccgagcactggagatcatccatgaattagaaccctatggcaggggcgtttatggtggttgcttaggttacatcacttggaacggcgatattaatctcgctattaccatccggacagggttacttcatcagggacaactgtatgtacaggctggtgctggaattatcgatgcctccagagcggaacgtgagtggcaagaaacgatcgaaaaaaatagcatgatgatgcatgcagcatatcaagcagagcaattttctttatgaaatggtataggaaataaatcatgtatttcattatagataactatgactcctttacttacaatatcgcccaatatttgggtatgcttggtatagaggttttagtcaaaaaaaatgatcgaattaccttagaatatatagaacaacataatccgactggattaattatttcacccggcccttgtaccccgaatgaagcaggaatatcaacacttgccattcaacattttgctggaaaaattccaattttaggtatttgccttggtcatcaatgtatagcacaagaatttggtgggcaagttctcagagccaataaagtgtatcatggtcacacttcaacaatcacccataataataaaaacttatttgccaatttaccccaagatatcaaagttggctgttatcattcattggtagtagatgacttgccggaatgtttaacagtgacagcaaggtcatgtgatgaatacaatgacattatggcactcaaacataatgattttcctatatatggagtacaattccaccctgaatctattctctctgatttcggactggatatgcttaaaaatttcatcaaaataacacaagaatggaagctgatgaatagcatacaataatccccactggcaatatcagtagctatatatctgccataaattatatagtttcacaaataatcataatgtagtaaattattttatatattgatattcaaggagatattgaccaatgattacaccagaagaaataaaaaagattattagctcggaaaatattggtgctggtaactttattcaccaccttaataactattttagtgaacgaggaattagcccaaaaataacatgtgatgtaccaacatatgataatccagaagaagaaaaatcacagtttgaaatcaatgatcttgttaagatatcagatcaattgtcaggagcttatattgcgctaggcgtccaaaaacgtgaacccgtggcattatattttgatgatactattgactatttaattcactttattgcactgaacaatataggctcgttccctatttttgtgaatggcgatctcagtagtcatattgctatgtcgtttatgcgtaatagcggaacaaaatttattatttcaacggaagaaaggattaactcactggatgataaatctactgacatccagtttattactcccaacgaactgaatttatttaaaaaacccatttcaagctattatcggcatcatgcagacgatattattctgttagggcatacttccggcacaaccggtttgccaaagccagttatttttacccatgaatctatgtttcacggtatttttaaagaagtcagtaagcaacgcggaaaacaaatattatccatgttcccgcactctcacggagcctcgatgacattgatcatgttgacattgacacgaggtgcagcaatacatattcaatcaaagaaaaccgcttttgacattttagattccattgaacaaatcaaacctgacaccgttgctgcttttcccaaaatatttgttgatctatgcagagaagacctcaatgactgggatcttgattctatttcccactgggtttccacgggtgacgcgaatcacgaaccccatatacgaaagctgatttcttatggtcatcatttcgttgatggcaaaaaagagcgtggatcttttttcatcgacaatcttggctcttcagaattcgcatttgccatgttcagaaatattcatcaaccaaaaacagacagatatgatcgttgtattggaatacctttttcctgggttgatgctgccatacttgatgcagacggaaatgttctccccaataaccaagtaggtatgttgggcgttatttcaaaatcagtaaccatgggttactggaataaccatctcctgaccgagaaaaaccgggttaatggttattggttaacaggtgatttggtttaccgtaccaacgacggtttcttttaccacgttgatcgtacatcagattggattaagactcctcaagagccactttacagtacccaatgtgaagagtggctgttgaaaaatattgatagtatttttgatatcagcatcgtcgctacttccctgcccaatggcgatcaacagacaacggctatcgtcgagctgaaagcagggcacgaaatttcgccggccacactgttacaaaaaatcaacgcctgccatcaggaaaaacaatggccattgatcgacaatattgtttatcaatccgctgacaacgatctcggagtcacagggaaaaaactcaaaagaaaaatcagagatcgtatgcctgaagataattcaatggtaactgaagaaggaaattaatatgaaaacttgcttaattacgggtgccaacagaggcatcggatttgaaattgctaaaaaattgggtgaacgaggccatcgggtaatcctttcaggccgtgatatacctgcgcttgagcacagtgttttacaattgaaccaaatgggaataaccgccgatttgcttcatttggatgtcacagatccagaatccataaaatctgcggcaaatttactgctcagcaccaatacaacccttgatatactgattaataatgctggcgtttttctggattcaatccaaaaacccagcgaaacctctctggatgacatccataaaagtctgacggtcaatttggttggcccctggctcatcacccaagcctttttacccctgctctctcgttcagaagaagctcgactcattttcttatctaccgatcttgccgctttatcccaagctgctgacccgcattcaaaatacaacagaatcgaaggtccagcttatcgagcctccaaagccgctctgaacatgctcgctttacagtgggcgaaagaatttcgtgattcgaagatttctgtcagtgtatgcagcccgggttggtgcagaactgacttagatagccaaattagttcagaacaggcacccaattctgctgccgaaggtgctgatacggttgtttggctggccttagataagggcagagaacaacacggccatttttattcagctcgccagactattgattggtaatgtcctaagataaaaaatgtatggagataacatcatgacaatgaatgaaaatatcgatattaccgttcagcaaactgaaacagcgtcctatatagacaaactggttgaccagggaaaaatcgcccaaaaagaattggaaaaacagtcagatgaagatattgataacgttcttcatcatttggcaaaaatattttccactcactgccgggaatgggctgaaaaagagcttgctgtgacccgtatcggcaatgccgacgataaagaacacaaattagctttagtagtcaaccaagtatttaagggattatatggcactaaaacctatggtcgtcttggtggaacccaaaggctcattgaatatgccagtccagttggattgatctttgccgttgtcccattgacaaacccgattccaaactcgcttttcaagatcatgctttccatcaaaactcgcaacgctatcattttcagttatcccggtaaaactggcaaattagcaaatgaatttattgatctggtacaacaggttcttaccgagcacggattgcccgtttcattggttcaagtctgcacgcctccaagccatgataaaacccatatgctgatgcagcaccccggtgtagacatgatccttgcgacaggaggaagaaatctggtacatgcggcttacagttctggtaaacctgcgtttggcgtggggcctggcaatgtccctgtctatatcagccgttccgctcacattccgaaaactgccgccaatattgttaatggaaagatatatgataatggcatcgtttgcggttcagaaagcaacctcatagtacatcctgccagcaaaaatgacctgatctcagctttagaagccaatggcgcggcaatcttgacaagcagcgaagttgagcaggctatccagacgttatttaacccagaaacccagtatgtaagccgtgaaaatattggtgtctgcgcggcatctttggccgctaaagccaacatttcacgcgcttatcccattaaattgctggttatacccgctgaaataggcaggaatgattttctcagcaacgaaaaaatggcacccatactgactctttatactgccgatgaagaaaatgggatttctcttgcctattcattgatttgtaacgaaggcgcggggcatacggctgtaatacacagcgaagatccagatgaaattcatcaattctcaaccgtcatgcctgccggacgcattttggtgaatacatcagcaacacagggcatgctcggggaaacaactgagctacctgtgtcattcatgcaaggcagtgggacttttggccacaatcattcaaccgatccgatcgtctggaagcacttagtgaatatcaagcgtgtcgcatacggcctacactgattttgctaatacttgcgaatttacgtaatttgggaagtagatataatgaagatacagtgtattggtgcaggccccgcagggttagtgttctccattctggcaaaaatgcaggatcataaccgtgatgtcgttgtatacgaacgtaatttatcaaacgttacaacgggttgggggcttgtactttctgagccgatgttacagcaattagccaatatcgatcccagtattgttgaacagctcagacctcatatttcaacattaaaccatattgatattcatataaaagaaaaaactttccgttcatctggataccaattccttgcgatcagtcggttagaaatgatcaatacccttaggaaaaaggcactggatctgggtatcaagattaattacgactcttcattgaatgctgaagatcttattaacttccccgctgatttgactgttattagtgatggcgccaacagtaagataaggcatcagttaaaaaatgaattcgacactgacattgatgaaggaaagaacctatacttatggttaggaacttcacatctatttaacgatacctttaactttattttcgagcagacagaaacaggttggttttgggcacattgttacaaatttgagaatgatcattctacatttgttgtcgaatgtactcatgaaacttgggcaaaaacaggatttgcacatatggatgagaaagaaaccattgcatttcttgaaaaggtctttcaccgacatttatgcggccatccattgcaaattaatgatacgtgccgtgaaaaagcttattggcggcgttttgttacaccagtcagcaaacactggtctcacgataaaaaagttttattaggaaatgcagcgcattccgcccacttttccattggttctgggactaagctagcaataggtgatgccattgcactggcagaaaatctgaaatcaagcaataaactggattcagcctgttttacagattatcaacacaatcgtcaaaatgaatcatctaatttacatattgcagcacaaaattctcaatcttggtttgaaaatgttgaatcattaattgaaaatgacccattagagttttctatatctttgctcttgaggagtggtagactatcacgcgatgaactcaccataaacctgttagaataaggttttcaaagaatcagatttatattttattcatctttttatatcaattgaaatagtaaatgggagtcaccaatgaattacgcaaaaatttcacctaaaataattaaccctctgtataaatgttatgatgaaatacagaaatgtgaattagaccaatcacttattcttttggttgaaatgcgaacctcacaaattaacggctgtgcctactgttgtagactccatgcagaaatggggcgtaaactaggtattgaggaagaaaagctggataagttacccggttggtttaactcccgtatttacaatcaaaaagaagtactggcactggaatggtgtgaagcattaaccattggtcttagggacaaagatcttaatgatcttagagaacgtcttgaagaattattttcagaaaaagaacttgttgatctgacctcagccatatcagtaatgaatgccttaaacagaatggcaataagtatcggtgataacaactaataaattatagttcttttgataaagatagttgcttgattgatctgttgaataatatgtttcctggattattccttccaggaaacactataatcataaaattcaggagaagcctatgttaaacggaactcaattaagatatgcagctttaatcgcacgttattcacttgcgattgcgtatttggtcgcagtggctgacagacttggtttatgtggtgaatatggtgatccacagattacgtggggtaatttcacggtattccttggtgttgttaagcacttgaacccttgggcacccgattttatgatccctatttttggttggggagtcactattcttgaagttgctctgcctatattcctaataataggttttaaaatcaaagaaaccgctttagtcagcgcagccttgttgttaatttttgctgttacaatgacaacggctggcttacttaaaagcgtgtttgactatagcgttttatctgcattttcctgttcacttctactctactgttttgaaaaattcagagtgagtgaagataaaaagcaattaaattaatttttcttagtatacgtcagagcaacatccacttcctatggtattgattatataaatcagtaccattctactcatagttatttatcgaaaccattccatttatatttaattacatcaagttattataatataaattaatacccacatatcaatttttaaacgtgaaatataacaaaaaacataaaataacattaatattcaaaaagatactaatcacatcataattaataaaaccctataaattttatttcataaaattattacatcttgacattacgcatatgaattactttaataatccaaaatatttaattcaactcaaaatcaagtattttaattagaaacaagaataacaaataataaaagagtaaaaatttatgatttttaatcaaaaagaaatgaatataatccaagccagggatttcatgaatgaaattttggtgtcaaaaaaaacaacagatattttaagacagatgatacaaaaagatacgattatcaaaagccctattggaacttatgttggatttgaatcttttatagcactgttgaaaatttggtacagagcctttcctaatttggtatataaagaaaataacctttacgttcataatgaaaatattattattgattgggaagcaaaaggaaaacatcttggtgaattttatgcaatttctgcgacaggtaaacaggttacttgccagggaacaaccgaaattgttatgaacgatggaaaaattctcgattatcatacaaaaataaatattcaaaatattattacacaacttataggcttaccctgctctccaacacttgacataagaaatatcgaaatatatcaattaattaatcagatattaggatatcagttatcttgcagacaaatagaatgcctctcactttccactctgaatacatcaattaaagatatagcaagattattatctatagaaagcaatactgtgaaaacgcacttaaaaagagctttcgaaatcatcggtattagcaataaaaaaatgcttatggaattcgttattgaatgccaagcgattgaaattctggttcgacttggcttatttttaagagtccaaacaaaaagaaataattatttagaataatggaacaccagagagggactcaatccaaattgaaaccattatccatctgttccgagtaacgatgactaggttgtatccctcaatcatcagccttctccatatcacgcagaataaaaatttcttccggcaaaccttgcgatgaatgctatcgtgagtataatgcgcgacgatttgctgggagaaaacatgaaatactgcaccacacacgatgttacaaagcatcaagctaacgaaaaactgcctgctggcagcttgggcgtattattttttccattgcaaaaccgatcattgaaaaagcccctcaaatgaggggcttttttttgcctggacaggcagggctatgagtaaaaagaggaacgtaaacatggctaatccgttatatcgcaagcatatcatttcaattaatgatctgagccgcacggatctggaattggtattgcagacggcagcagcattgaaagccaatccacagactgaattactgaaacacaaggtgatcgcaagctgcttttttgaagcctctacacgcacccgcctctcttttgaaacggccattcagcgactcggtgcttccgttgtcggctttgctgacagcaacaatacttccttgggtaaaaaaggggaaacactggccgataccatttctatcatcagccagtatgccgacgcgattgtgatgcgccatccacaggaaggtgccgctcgtcttgcttctgaattttccggccatattcctgtcattaacgccggtgatggtgcaaaccagcacccaacccagactctgctcgatctgttcaccattcaagaaacccaacacaagctagataacctgaaaattgctatggtcggtgacttgaaatatggccggactgtccactcgttgacgcaggcactggcaaaattcagcggcaaccacttctgctttattgccccagatgccttagccatgccaagctatatcctgcatatgctggataagaaacaggtcagttacagcattcaccataactttgaagatgtcatgcctgaactggatatcctgtatatgacacgtgtgcagaaagagcgtcttgacccttccgagtacgccaatatcaaagctcagttcgtgctgcacgccgctgatctggttaatgttaaagagaacttgaaagtgctgcatccgctgccacgtatcgatgaaatcaccgtagatgtcgataaaaccccttatgcctactatttccaacaggcaggtaacggcattttcgcccgccaggcgttgctggcgctggtattgaatgagagtgtcatcatagaaaaatgacgacatagcctattaagaaaaatagataaccattaatattatgattaaggaaagatatccttaatcataatataccagagaaaaataccaacaatctggctgttctcaattcacccagctgtgccgctgtattccggcagaatagcgtccctttgtgatgataccatcatgacatcgcattcgttacagctataatactaagatgttttttttcgtaaaataaaaaataagaataaagataaaatcacaactattccactgagcgaataaataatatttacattttctgttttctgttttctgttttctgttttctgttttctgttttctgtaaaatatacccacttattagagatgacaaaggaatagccataaatgaaatcaaccgagtaaccgagataactctacttaaaataaacccttctgttattttttgtcgataggtaaaaaatgtaaccacgataattgactgaacgaatgaactaagagacaaaatcaaagacattacaatagcattattagctaccaaaagcagcagactcaatacaccaataaagaaagtacttcctgcaattatattttcatcattaaatttacctatcaaataaattgcagccttagctcccaaaaaagaacccaatcctatgataacaaaacataaagccaactcatcatctttcaaataaaagaccatgctatatatccaaaataaattaacagcaattactcttattccgaaattcacgaaaaagaagagaattgatatattccttagtccttttacattaaatacatacttaaccccatcagacatggaactcatgatattactaaatcgaaaggcgacgttattatggtgggaggcatagagaataaagctaaaagaggaaaatgaaagaacataacaaaagattatcaacactattacataatgcttatccatacttagtaatatcacaccaagaataactggggataatatgcttaccaagttatcaattatgttaatattagagttgattttctttaagtcatctcctttatatatatctggtatgatagcctgaaatattggatgatgaatagctgacatagatgaaatcacaaatcctagtaaaatcatctcccatacaaattcgttgttgaaaggcactaaaagcaacacagttgcagttatagcacaaattaattcccctaaaataatcacctttttcctatttaccatatcacctatcacccctgcgaatggggtaaatattatatacggaattatatttaatgcatatgaaacagatactaaaagaggagatttcgacacatccaaaacgattaaaggaatcaaaaaaccagcaagccaatatccaaatgaagtattaaagtatgaaaaaaccagtttattaagcatattctttattccgcgaattcttacagcatagacagtctatatttttattccatttctcttcagtgacaatttacagatcatcaaatatgaaagattttcttttattagtcaaaccagcatgttgagatttgcttaacaatttaatggcttcacaaaccataatgcctgctgtaattgatactaggctgtgtcccttaatgtaaattgatagtattatcatctaacttgttttcaatacgggaaaaagatgatggcacgctacgacattcctgatgacgcatggatagtgatagaaccttgtttacctccggtccattcagagcgggcaggacgtccacatgttgaacaccgccgagtgatgaatggggtgttctgggtcttgtgctctggggcaccgtggcgtgatttacctgaacgctatggtccttggaaaacggtctataaccgatttaaccgcgggtcaaaatcgggcattatcaacaagatatttaaccggttactgtccattctggatgaaaaaggcttgattgactgggctgaaatttgcctggatggcagcaatattcgcgcgagtaaagatgccgcatgcgcgaaaaaaaacctcccgatatcgctgacgatcatgcgctgggtcgctcacgcggtggttatggcaccaaaatccatctggcaaccgacagacggggttttcccctcaacctgcttttgacggcggggcaagcccacgaaagtcgatccgccatccctttgctcgacggcattggtatacagcgcaaaaatggtttcatgaaacggcgcggcaaagcggtgctggcagataaaggctattcgggcggaaaactccgcggttatctgcgtaagttgcggataaagagcattattccgtataaaatcaatgaaaaaggcagtactgatggtcgcacacaatttgatgagcaggcttatcgtgaccgtaatgttgtcgaacgttgtttcggttttcttaaaggaaatcggcgtatcgcaacccgttacgaaaaaaccgctcgaaactatttgtccagggtgaaattaggctgtattcgactcttttacaggcggttatctaattaagggacgcagcctagcacgactactaaccacttaaatatcttgattaaatctaatctgattacatttatacgtcgtggcagatacaaatatttccagctagctaataatgaagttgcccacttattggagtcaatgatggttctgggtccacctattaaggttcaacgtaagcttccaaaccccgatttgtgtacagcaaggttttgctatgatcatattgctggttttcttggcacaagcatttataaattcttaatttctcagaatttcatattgcaagataacaatcatttggttttaaacaaaaacatagacaatttacttaatctactaagagtagataattttgaagatctgtgcagaggaagaaaaatagcttatgcatgcatcgactggagtgaacgaactccacatatcgcaggagcgttaggaacagcattagcttatgcatttattgataataaatgcataaagagaagagaaaactccagagttattgaaattactaccctaggtaaaatatctctctcagagaatttcaatataaatattgacgaaaaataataccaatgaattttaataactaattatgactatttttatactaataaatgcggattatagggttatatacccaatgttcttaccaaacatataggaaatgattgttttatgggtaatgagaaaatagtttctttctggcggtattggacgaacgtgacagcgaaaatcagcaggcactcacgctagccgctctggacgaatctgataacgcctcctgattggaggcgtatttttcattgagctacaaaaaattatacaaggcgctgaagttccgcttcacctatctcagtcagagataatttaaccggcacagattttgacgttggtgtgcccgtgccattgccgatactatccatcggcactaatggattggtttccgggtaataggccgcaagattcccgcgtggaatggcgtaaggaaccagcttaaagccatacactttgcgctcaataccatcattccataccgtctcgatatcaacccgatctcccgcttgataccccaataaagcaatatcttctggattcataaagagcacctcccgctgaccataaaccccacgataacggtcatccaaaccatagatggtggtgttatattgatcgtgagagcgcaaggtttgcagagtaaaaggaacgtctgttttacccagttgcgggaagagattttccggcagtgaggcatcactgaactgcgcctttttactcggtgtagaaaaacgcagatccgccgctgcattgccaagatagaaaccaccgggttgttcacattttttattaaaatcggcaaaccccggaatggtcgcagcaatgtgatcgcggattttattgtaatctccggctaatgctaaccagttaatcgttgctgtatttcccactaccgcattggcaataccagcaacaatcgccgtctcagagcgttgagtatcaaataaaggtttgttcagcccttctgaagcatgcaccatgctgaaagaatcttctaccgtaataaactgcgctccactgagctgaatatcctgttcagtacgccccagtgccggcaggataagggcatcttttttaccggtaacaagatgactccggttaagttttgtactgatatgaacagtaagatcacagtgtcgaagcgcctcttctgtgcgtgggctatctggcgctgctaccgcaaggtttcctcccaacgcgatcagtactcttacttcatcacgcagcatggcactcaatgctttcacaacatgatggccgtgggaacgaggaggctcgaaaccaaaatgttcagccatgctatcaaggaaagccttcgagggttgttcattaatccccatcgtgcgattaccctgcacattactgtgaccacgcaccggacaaagccccgcaccgcttttacccaactgcccaaacagcaattgaaggtttgcgatttcacggacagtatccaaagagtgtttatgttgagtaatccccattgcccaagtacagataacccgatcagcatgctgataaatggtggccgcctcacgtatctgtgcctgcgtcaaaccggattggctctcaataaatgcccattccgttacagcaacttcttgcaaataagcgtccacaccttccgtatgagtcgaaataaattccagatcaaaaatacctgatttgccagccgccagaaatgcgttgtgagtttctaacagtgccttgaccattcccctgaccacagccatatctccgccaagtttgggctgataataacgatggctgatagcgcctgccattggggtaatcacttcgagcggcttttgtggatcggcaaaacgttctaaaccccgttcgcgtagggtattaaaggtgacgatccgtgcgccgcgttcagccgcatggcgtaaactgtgtagcatccgtgggtggtttgtaccaggattctgaccgaaaacgaagatggcatcagcatgatcaaaatcatccagccgaatggttcccttacccacacccaaactcttcagcaggccgtaaccactggcttcatggcacatatttgagcaatctggaaaattattcgttcccaacacgcggccaaacaactgataaagccatgacgcttcattactggctcgaccggaggtatacaactctagctgattagggttttccatcgccttaatgtgtttggctatcaaggtaaaagcatcatcccagctaatcggttcatagtgatccgtctgatggttataacgcatcggttcaacaacccgcccctgatattcaaggaagtagtcactctgttggtagagtttactgacgctataagtcgcaaaaaatgcccgatcgacatgccggcgagtcgcctcccaagtcattgccttagccccgttctcacagaaactgaacaggcttttgttgtcatctccccacgcgcatcccgggcaatcaaagcctttggctttgttcatgcgcatcaggttaaccatattttttaaggcttgtttactatcaaaaacaaaacgtgttgttgcttctagtgaaccccaaccacccgcagcggagtgataaggttctatttttgatttgaatttcataaaaatctctattttttaacctagtggtcaaaaaattggccacatgttggcaggtgaaccaataacaccgaattggcttattgaaggataaccacggttttaatcataggagagaatcgagcagtaatattcatgatatagctataatctaaacaatggtttcctctttaataatgatccattgtgatacttattccgttcttaggcaacggaaaaaccgatctattgctattgagagtgctatgtcagctcctcaaattaaccatactatttctattggtaactttatagacaactgttttataactgattgcttatttgggatgattttcgtgatgtttacgataacgactgagacgtatacaaaatagatcatataaaaaattaacgaagtagaacaattgctatttttaatttagccttcaaggccttacttaatcaattcaaagaaaaaatgaatttaaacaatggaatattattatagatggcggattaaaataataatttcaaaaattaaaattagcctattccattaggctctcattatttagataaataaatatcaataaatattttagttaaataaaaatgagtgatatttatcgtagcacaacctcaattacatccgccccacaataaagtacacaaaagtccccacatagttgccaatcacataaccgactgtaccaatcaccataatcgggccgaccagattgacccagccgcggctaattgccatagcggctgccgttgttggccccccgatattggcgttacaggccagaatgttctcttccagactgaatttaaacactttccccacggcaaaagtcagtaacaggttgatcatggcaatcacaaagacgaaagcaaacagcagtggtgcatggctaatgatggcttcaattgatgccggaatgccaatcacgacaaagaacatataaatggcataagtccccaattcctgtgtgccattcagtttgctgaatgtctctttaaagatcgagacgagggtaaacgtcacggttgtgaggatcaggtatttatcggatatcaaactgaaaagcagttcctgataaatactgtttggttgccccagcagggcttttagccatgtagataactgaaatgacagcgcgacgataaaaatcgaccatgccagcgataaggcgatgtctttcagagcgatatttttcggcttccaataagcggctgcaaaagtctgggatttatccaagtctggatcgttatctattgcgtcagtatgaggactgccccagaacttccttgccactgtccagccagataatgcgatcaggataataaagtaacctgccatcatcatattatccgccacgatagtggatgccgtcatactttgggaaggttccaatttagctgccattgccgcaaagttaacacctcctcctgtatatgaagccgaaatcataccgctgattttatctagttccgggatatgatccttgaaaagccggaaagaaactatcgcgccaatcatggtggcaacggaagaaatcaaaaataagatcagtaatcgccaactttctttgataatactgtgtaaattggtttttaataacaacaaggggatcgctaatggcacgatatatccccaaaccgcatcgtaaacgggagcttctgttggaatgatatttaagttagacgctaataccgcaataatcagtgcgataactgcacctggtattttagatgcccatcggtatcgctgctctaccataattgccgcagcaaccgcaatcataataaaagcccaaagcattaatgaattatcagatgtaattaaagtattgttcattattttccctggtgttgttcaagtcgataaaatcatttttattttgtcatttattacagaattaacgatttcgttatctttttcgcgttccatctacagcaccataaatggcaatatcgtttttataaaatgcccacagagaattaccgtaatcataatgccaccattccgtaggtaagttggtaaaaccaacctgaatcatggcgttatacaataaccgacgatataaggtggccggcatatttttttcaggttctttttctaacgccgccgtataagacagctctgtcacttcgtcaaattcagtccccagaaacaggggcttgccagatgccacgtcaaatagcgtcacatccacggaaccgcccgtcagatggggactgatttggtgctgttccgtaggagcaggagccacaaactgctgcaaaagtgccttctgttcttcaacagataaatggcgatattggtcagctatttttatctgtgtttgctcctgtaatgcctgctgggtttcccgcgaacgccagccatctaataccaaaagccctaaatgaggaggtagcaattgtgatgccatcactaattttctggcgacactttctcttacggtgcaataatcaatggaaccttttatatcagcaagaaaataagcagattgctgttttaacttatctgtatcagtaattatttctaaaggttcatgacattcattgatagatactccattaatcacttcccaatcaaaaagtttttccacagcgattttatccacggtgttattttccatagcaatagatagaaacatattcgcccttatattgtcatattcgaatggatagggtttttatttgttattttaaaaatacgaattaagttattagttttactttacaatcaataacaatacctttacagattagcaacaaaaccacgtctcatcaatttttattttccgcatgaaaaaacaattaaaatagtctattaaattaaatagataataatacctcatgtattttttacttatattattgagacaagtaagtagggcttttaattaatatttttttattccatccgctatcgttcacagctcaaacaagatatcgctggatgcgtcgaagaccgatttatgcagggtgaaatgccaaatcttatgtgacagaataggtacatgcccttgatcccctaatatccggaggaggaatacctgaacggtattcatgacacaacatgacccaagaccatcaattacaagtagaagccattaaatgtggcaccgttatcgatcacattccggctcacatcggtttcaaattattgtccctgttcaaactcacagaaacagatcagcgcattaccattggcttgaacctgccttccaatcaactgggcagaaaagacctgatcaagattgaaaatacttttctcacagaacagcaggcgaaccagctcgcgatgtatgctccccatgccacagtcaataatattgaaaattacgaagtcgtgaagaaggtacccatcaacctgccagagcagatagacagtattctcgtgtgtccgaacagtaattgtatcagtcacaatgaacccgttgagagcagcttttatgtcatacccaccgccgacgatgtgatcgttcgctgcaaatactgtgagaaagaatttgaccgtcaggcagtcattaacaacgactagcattctgccaagatagtcctatcccaagggatttcaagatgaagggtataagctgccctgtaccagttgaagcaggactggaggtcactataatggttggctctcatattttttcattcagacgttaaacaggagtttctcatgtcacgttccatttataccgaaaatgcaccagcagcaatcggcccttatgttcagggtgttgatctgggcagtatggttatcacttccggccagatccctgttgatccaaaaaccggtgacatccctgaagacattaccgcccaagctcgccaatctctggagaacgtcaaggcgatcatcgaacagtctggtctgaaagtggctgatatcgtgaaaacgacggtatttgtcaaagacttgaatgacttcgccaccgtaaacgcagcttatgaagcgttcttcaacgaacataacgcgccattccctgctcgttcatgtgttgaagttgcccgtctgccaaaagacgtgaaaatcgaaatcgaagccattgcggttcgcagctaattctctgctctctcagctctgatagtttcagtatcagagctgtgatttcttcgatcttatctgtcatcagcgcggcaaaataacttattctttctttatgttagatcaattttttacgctgacgttaacgttgccaattcagttttttgccaaaaccaagggtgttatccaccattttgatttcactcaggctgagtcgccagataggggattttgcagcgagggcgacgggaaaacgacggcaataacgtgctctggcaagagtttcggcttcgcctgtcagcggtgtgatttcaccacggaattgaatacctttgatttgggcaatgttacggggttgccctgcaacagtgccggcaactactgggttttgctgcatcatctggccgtggcgggtatccggttcggtcataaaccagaatgccatactatcggcatcaaacgcatagaagcaacttgcacaccatagatcttgtggtgaggaagtgcagagagtgaagacatgttgtttggcgaggtatcggcggatagttaagaaattttcatttaattccatatagttccatacctattatatttacctattcatatcagaacacaactggatattcagccagccacgtgttctgatatttatataatcatgcagggtcagtatggatgcactataaattatttatagatttcagcaactccactgagtttattctgaccatttgctgaaataacacggaaatatgatgcacccgctttatcagcttttttggataactcagcggtcagactatccagggtctctgcaccagtaactgaaacaaccccaaccttctctcccttagcatattgcacttcagttgcagccatagagccaaatgaaatagcagttaatgccaaaatagcgacgatatgttttacagctttcatctttcgatcctcagttcacttttaaattaggagggctatctctgtgatgtggatcatgttatacgcttcttatgaaaatgataattagcaattcttgctatactatttcaattattttgaataaatgatgctgtgattccatgctagatagaatataatttaaaatagttcattgagttatcatgatcaaaaaatgataattcagattatcactaaataatgaatgaattttatatggcaataaaatcatgcaaattatttaatataaataatgaatatgaaatcaacccactggtatctctatctgataagaacccgaaacagctctctgtatactgggattaccacagatatcgcccgtcgatttatgcagcacgtgtctggaaaaggcgccaaggccttaaaaggaaaagggccattaacattggtctaccacagtttggtggaagatcgaggcatggccctgaagttggaatatcgcgtgaagaaactcagtaaaaagcaaaaagagaggctggtcactctccaacctgtctgtatagcaacctatttgtccgagatgttggtgccaaaaatagctcagtcagtcatcactcatgaccaaaatggtcagaatacgtaatcagaccgtggcaattttccagtgagacatccgccaacgtgtagatctggaagttatcctcacaatcaggccattggcaatgcaattggtattctttggcaagcctgaaaccaaaacgacggtaatacgcaggctcccccaatacaacaaccgcgccatagccaaattcgtttaggctatccagcccttcataaaccaatttttcaccgattccctgacgacggtacggttcagccaccgctaatggcgctagcccaacccattgatgatcctgaccattgacatcaacaggagtgaaaccgacatagccaatcacatgaccttcatcgtcagtcgcaacaatacccagcgtcaacagaccatcttctctcaatcgatgaactaactcagcttctgccgatgtctcaaaggattgacgtaacaagcgatcaatacccatggcatcgaccggaatttcgaccctgattaacatgacgataatgcgcgatcgtgctgatcaacgccctctttttgtcccgctttggtaaattcagccagacacaataaacccaagcggagaatggatggcatggatcccagcctaatggaatccaccaaatttttcacatgcagtcccaattctgtatttccttcaatccttaaatgatgctgaaaaaacagtgtatcaggatcttccctgcgagactccaaaaacgccagttctccctcagccaatgcctcgtggaactgccagccaagcagttgttccagcacctgacgcggtaaagcaaaaggagtcaccttcaatgaaagacgcagtaatgttggcccctgactgaccaaatgggagtggattttacctaacacagttcagactcctttttcgtgaaaagtaacgcgcttacatcataagcctattttttatccttcgaaagaaggataaaaaataacacagtcacattcaaaaaaatcaccataaaccatgcaacccaaaaacctagaaaatcagacaatacacccagcaatatactcagtccaacagaaagagtgataaatatcatttcattgaatgataataatcttcctagaatttgattacctgcttcattcataataattgtatttcttattacccgaatacgtgagtgacttaaagaaattagaaaaagacacaaataaacagaataaagatgattaaaaaaaacaggtaaaaaaagacctattatagagatagttccgaatatgatatagttattttttagtgacaaagatgatcgctttgaaccaatcaaactacccattatagcccctaccccatatggaacaactaacagcgcataatactgtatctgcgcatttataacattaaaaaaagcagggtatattgaatttaatgatacgacacaaatatatggaaatattgacaatagaacaacgtgtctttttacttcaccattaaaaaaaccatatcctattttataagtatttttgattccactattattgtcaataacacgatcaaatttatctgcattatcttttttaacataaatatttataaatagagaaatagaaaaacaaaaaatacttacaatacagacattacttatcgatttatcttctaaaataaagaaggctataccgccagacagaaaagtaattccctgcctaattaattcaaggtttttattagctttataaagttcttcgctagagacaactctttttatgtaagttgctcttattacctgatcggatgaacgaatgaatgtaaatatacttgtaagtataataacggtggctataagaacaatttcattcaaatttatatttgttaaaaacaaaaaaacaacgctatttaaaagacctagaatataaatattatttaacgcttttttagcagagtttgaatcaataaaaaaacctatttttggcagaataaaaaagtcaatatataacctgacgaaagaacaacagatactaacgttgttgaataaaaacttccctctacaaaccaagagatggcagtaaaaaaaactgccattgatataccagatgttaaagcagaaattaatattgggatcatgttaaacaccgaaatagtcgactcgttgtcgaggtatataattcccttgctttgtataatattcctctatttctaagcattgcaagtcaatagcatgtttaatatcatggattgtatttagaacatatgaaacttcatcaacatcattaaagttaattaatgatagttttccagcataaaacctaacaagacattatagcttacgtcaccatataaaaacttattgaataaatgtgtctcttctatttgctctgcccacatctcacaggcaataatgatcttatcaaaaaaatcttcttcactgacaatttcttcattccttaacattcctatttcatgaagagatgaaattatgtcaacaattctatcttttggcattcctgttttctcatggatatctgttattgtattatgcccagtacaatatcctcgtattgtaataaaatctcttgcatcatttgagtctacttcatacaaccctttggtaaaacgtaaataatattcatcgtcttcattttgagtccataaattatgaataaatttaggtttttctaaataattcttactagccataatgaggctcctagattagatgaaatatggagccagaatatttgctggctccaactcaaaaaattagccgcatgttgctccacctaattttttattactttttttacttacttttttcattttcataaattatctcctgagtctagtttgattgtctgaaccaatcagacaattgtacattactcatacaaatttcaaaaatcaaaccagatttaacattttgttaaaatttaagatacagatcacaaacaagtataatattcatattaaaaacagcgtcgctattaaatatataataatcagaattagtgaaatcatttaaataaataataaaaacaaataatgactttattttataaatttcattagaaaaaattcctgatacgaaatgaaatattccgcaattcctcattgacgcgatgtaacggatttctacctcaatctattgattgaagccgaccctgtagtacagaggtcggcaaataatatactgagggagagcttaatgggataattatcgtgattcagggattgaacgttgctcacgcatagatggaataaccatttgccagacaagggatacgatggccagtacacccgtcactgcccctacccatgttaatgtttctaatccccactctcgtactgttgcgccaccaatcacagagcctagaacgaccccagcattaaaagccgcgatattcattcctgacgcgatatccattgcatagggtgtgtgacgtttcgctagcatgagtatccttgactgcaatggcggaattgctccataagtggccaatccgagtagagccgtcaagccaatcatcagtagagaatgggtcagactaaaactcatagcggcaagcacaaccgcaataccgacaagaagaataagtgatgcgagatccattccttgtcgatcagtcaatcgcccaccccaaaccgtaccaacagcagcgccaataccataagcaagcaatactccactggctgtttcaacacttactcctgtaatactcagtagtataggggtaataaaggtgtacaaagcaaatgaagcggtataggaaagcattggaacactcgcccctgccagtaaacgtcgatcaaaaagtatagtgagatggcgccagctagcagatgtcttcacaatctgctctccggcatcttttggcattttaaatccaataccaagcgttcccagcaacccgcaggctgagataattaaaaatataactcgccaatccaatatactaccaagccaagttccggccggcacccctaaagacatggcaatggtaacaccaccgaataccaaagcaagggctgttccggcacgttcaggtggaaccagtcgagtcgcaacaccggaagccacagcaaaaaagaccccgtgtgccaaaccagataacaagcgtgcagctaaaagaagagccaagtttgctgatgcggctgctagcagatttccaagagtgaataccaacatcgcagtaagcagtaagcgtttcctcgaccaattagatgccagtgccgtcaaaacaggtgccccaatcacaacacctaatgcataggctgtcaccgttaacccgatactggttacatctgcgccaagatttactgacatcacagatatcagtccaatagtgatgaactccgtaaaccctatcgcaaatgcacaaagcgagaatacatatatcacgaatggcattaaaaactctccttatacgctcaaaacgcgccaacctgaattcaaagtaagtaatcagtatcaggcttccatttagtgcaataaatattcataatggataaaaacttatgataggacgtcactaatggtacttcgtaaccttgaagacctaagtgtatttatcagaatcatcgacacaggcagtttcactgctaccgctcaagccttgggactgtctcccacaactgtcagtaaacagattgcacgtctggagaaaaatcttggcatagttctctttgtacgaagtacccgttcattgcgcattacacctgaaggcaaagcaatcgctgaaaaagtgagggcggcgctgacactggtggaagaagcggctgaaattgccaaggatggaagtgaatctctcacaggtttgattagacttaccgcgccagtaccgcttggtcgaacttatgtcgcggcagcaattgcagagtttagaaaaaaatatccatcagtaggattcaccttgcatttgacagataaaattgttgatctttataaggtcgagatggatttagctatcagagtcgcaaatttaactgattcaggtttaattgccaggcgcttaacagataacaaacgaattttagtcgcatcacctgattacctcaggctgcatggcgaacttcagcacccagaagagctgattaaccataattgcctgcttttttccgcctctggaaataagagtacaatatggtcacttcacgataggaaagacaccaaagctatctcactctcaagtgatttaatcgctaataatggtgatgtcttgcgaacttggtgtacggcaggtttaggtatagcactgcgagaaacatgggatgtagtcgatttaattcgctcaaaaaaactcacccagatactgccagaatggcaagaagaaacctctccaattaatgtcgtgagagccggaaaacggcctgttccgcaacgcatcaaaagcttcatcgagttcctcaccgaggaatggagaactcccccgtgggataaataactgaacaagccggtaaactgataatcatcccgacttgttcctgccatcttacaaaatactttgaatgacgccaccatcaacacgcagggcagtacctgttattgcagacgctagtggtgaagctaaaaagagaacagcattagcgacttcttcggctgtggctaaccgacccagcaacgatgcgggacgtgctgtttcaataaagcgttttcctgcttcttccattgaaagtgttgggtccgtgataagttccctgacaaatcgctctaccccttcactttcagtgggtccaggtaaaacgctgttgacagtgactcctgttcctgtagcggcttgtgcgaaccctcttgctgctgcgacttgagcagtcttggtcaggccataatgtggcatttctaccgggatttgtaaggctgactcacttgagatgaataccacacgtccccatcgtttcccaatcattagtggaatgtatgaacgtgccagacgaattccacttaggacgttaatattaaaataattaagccactcatcatcgctaatttcaaaaattggcttaggagaaaaaattccggcgttattaaccaggatatcaatatccggaaaatttttgttaatgagttcacagcctgctttggtgccaacatcagcagctacagtaaaaacgcgatccaagcagtcaaatttattaaccgcctgtatgagcctctcttcacttcttccattcaaaatgacagaagcaccagccttatgcataccctgagcaatagctaatccaatccctgctgtcgaacctgttactaaagcaattttcccttttaaatttatattcatataaccctctattcatcttctgtaagcaaaatgagtcttaacctatttttttaattagataaaaggagtcactccgccatcgactaaataatttgccccagtgatgaatgcagcagattctgaggccaaaaataagagcaaaaccgccacttcttcaggttgccctagcctaccaacagcgatatcaacttcttcaatataacgttgcaatgcttcttcacgtccaaccttatacttttgttcaagctgagttatcaatccttcaggtttatcgtaaatagaggtatgaataaaagcaggagaaataacattagatcgaatgccatatttgccaaactcccttgatatcaccttagacagagttagaactgaagatttcaagatactgtaatcagggagaagcaaatttggcattaatgctgcttcagaagcgatgtggagtaaaataccctttttctgattgcacatataaggtagtacaccgcgagccattcggatgtagccaagcagattggtttcgattgtagaattccagtcgtcatcggttacatcaagaaaacttttcctcggttctactaatgcagcattattaatcaggatatctatcttcccaaattgactgatggctgtattgataagaccatcaatatctgagggatctctgacattaaactgataaggaaataggtattcccctccctgcaactcataaagtttctcaaggttaatatcccctcctataacatacgcccccgcatttaaaaattccgtggtagcagcaagcccaatacctgaacctgccccagtgattattactgctttacccgctaaactacgctccatcagtatctcctacagtaacatctcgtttgatctggttaagatgtacaacgattcgtgcttgttttgcgacaaaataatttggtactgaataggcaatagttgcgaagtcaagctttccatcttgattgaagtccgccgccgctatgcgagcaactgattcactggaaacacgccaacgtgtaaaaatacctctcgataggtcaatggctttgtagtaaaaaacgccttgccaaggccacggccctcttaaagcaacaaggaactcatcatcgccatcaccatcaaaatctgcacaaagaacttgatgcccaggaccttctccattttcattaggatcaccaaaaacatccaatatgaaacgtttccaagtcgccagttcagcgggagtgcccagtttatctttaacatagacagcaaccgtattaccgtggaatggctcaactgccgcgacataagcgaaggaatcgccacctgcccgtcccacatcaaggtcaccgctaccacgaaagccagtactctcaaattgtgtaagttctcctacgccaattaatactttgatccattgcgatttttggtcgtcataataaagccaagtaattccttcatctgatgccagtaacaatgaatcacgatccgatccagggatcagcccacgttttttctccgcgccatgaatcaaacggaaaaatgtgttctcaatgatctccattggccattcattggctgtttttacattatcgggttttgtgaataaaaccaccggaagtagtgaatggatatttccgtgaggaacaatgggaagccctaaaatctcaaggcgatcagtttgagtaaaaaaacctgctcgtaaacgatgcattcctgttgtacgaccaacatagtgacgctcccaacgctcagattcgacaaattcagatccgggattctcaatccagtctattttgcctccggtgggatttgcatcgtaaagtgtaccgccagggccatacaagtcataacagacgatgatgtctggatagccattgccggatacatcggcataatccccacctacaggcattcttatattatcgacgacaaggtgccgcttccaatcagggttacggtaccaatatatttcacctagagaaagaccatatccaaaaaggtcaaataaaccatccttatttatatctggtgcttcaagccaatatccatctcgtaattgatcagcgacaagaacttgttcaaaaataggaatcggtaatttcgaatagtcattagtcatattgccctccaataattgggtgatattctactgccagccaaatacaatcggtttctgcgtaatattgatgccatggatattcaaattctgtgcaactcaaagcagaacaaaacggaggagttgtcgtgaacccaggatacattccaatatcttcataaagtgtattaaagtctttatctttgaacttctgcatatgcccaagaccaaatatttgtgtatggatctcaataaaagggtgctcacggtgtatttggcaatgcgttccggctgacgcaaaccacagattagtcttaacgataaatcgtgatgtgtgttcgattttgtctaatttcgatttctttgaaagataataaggtaaaaaattaacatttatttcagctgtaaaatcttgtggagaacgccataggtttatatcaaaattccctccatccttatttctttctgtccttttgaaaaatttagaccactgtgatttcccacataattctttagctgaaaataatttatccgtatcaaaaaacaataatagatcaccaccagagagatcaacattacgtagtttcgttgatgtcattggtagaatattatctttttcgaactcatcaattaacgcagttttatttcctaaattaacaacaatagcggaaccatcaagagatagattcccttcatcaaagacaactatagagggtaacaagtcatttgaaaatgttaataatctttgatggttagtaccttttattttcattcgatttctccatcataagatagatgatattaaaggagatatctttgttaaagagggggctggtgttaaagaagattgtttcagcctatttatttccttgccgcttaagcatcctctgttaaaaaattggtcaatagcatcaagaattctatgtgtcgattttccatcgccatatggacagccaccagccacaaaacgatcgtacacctctttattcgaaagtacttctcgtacagaattaacgatttccattcgatcattaccaactaattttgcagaatttgagaaaattgcttctggacgttctgtaatctcacgcagtatcagcgtaggcttaccaagagccggaccttcttcctcagcgccactgctgtcggaaagaatcacatccgcacgcaacatcaaccgaacaaagccaagataaggtaaaggctccaagagggttatattaggatgtttctgtaataggggaagcaaagcgtctctgatgatagggttcttgtgtaacggaaccaccacacgtacatttggcaacgatgcgacatcagccaacgcttcggctatttgagtcagcttagaccagctttcacgacgatgtgtagaagccagaataatacgtgaactgtcacgttcaatatcgtcaagaacagtattattaaattgatttaccttaggaatactccaattcaatgcatctatcactgtatttccggtgatcgcaatagaatcggcagaaattccctcatgcagaagatttaaataatttcctacagtaggagcaagatgcagtgaacttatctgtgagactagacgccgattaccttcttcaggaaaaggagaatagaggtttccactacgtaatccagcttcaatatgaattacaggaattttgttttggaaaccaaataatgctccggcaacagtggacgcagtatctccatgtacgacaatggcatcaattttctgcatcaccgggagtttagataacccatctaatattctatgtgtcacaccagaaatagtttgcctttcgcgcatgactttcaaatctgcgtctgcagttattccaaataccgaaagagtagaatgtagcatctcattatgttgcccggtggatataagaacggggtcaaagcgttcatctttacgcatttctataattggaagagcacacttaatagcttcaggtctcgtccctatcacaaatccaagttttaacattataattatcctttatatttgtaaaatatcagtttttattatttgcaaaaaaattaagatactttttctttgttttatataggaaaaccctggggaaaattaatcaatatcagaatcctttataatcttacctctcatcaatttactctattctcaatcatagcattgacataaaaagaaacactctaatcgttatttaacatcctttatttaacatgattttgatattaacttaaatattcagaaacttgcattaaaatataagaaattctattatgaattttcgtcataaatgtaaataataagaccatttataaaaataaaaatcataacaatatgattatattacttatattaactagaaaaataaatctaacaaaaaacagttaacaattaatattgtaaataaaataataataaatgagtatgaaagaataaaattataagtttaaaattattctataaaatagaaataataagttctcattaatttaattttcagtttttatgcgttatggtgacatcatctatagcaatgacatatgtagattaatggccatgtaaaatatttcattatagaatagtcaataattaccatagaaaacaatttagttaataaaaatttatacaattaattattttaataattaataaatttacagatgattaaacagcaacgatgcataacaatcattactattgcagatgataattattacaaataaaaattaattaatatcggtattatttatttttattcaaaatagatatgcattaccaatgagataatgaaataaactatacggataatgactaatcatacaataaactttcatattaaaattttatcactatttaaaataatatttatataacgatttgacagaataaatagatgctattttgtcgtgttattcattccaaccagtatttcttactgctaatagtgtacctaattgacattaggacaatataaaaataaatatcatctgtgtactatcaaatttcgtgtaaataaatactgatgattactctatagaataatatcaaacaaatagttaatagttggaagtaaaattattttttataaaaatgtcatttcttattccttaaatttatctataccattagtgtaaaatagctacaaaaccggacagatcatggtgatcttccggtctactttttatttatgtgccgttagaatattcgccctattcaggtaatatatgctgttttcggaaaaagattgatacgcccatttaaaagaaaagtgcaggtgtgatcatagaatagctttaaatttaatcagttattaaggagcaggatatttgccaccatcaattttcaactgttgattctgctgccaggctttctgaaatcgttctggattgctggcagtgtaatgcatggtatggtgaatattacgataccccaaataatcctgaatcagccgggtatctaatccttgatttgccaattcaaacccgcaggagtgtcgcaacttgtgtgggtgcaacctaatggataaacccacctgttctccgtatcgccccattaaaaaacatgaacccactgacgcgataattttccgccttttcgtgaaggaaacagccataaagaagcgcgatataccgagttgttatttctgattttaagccattttaagataagctctttttctgtttttgagacagggtgtgttgtgttgttgaaaatccattttttaaccgctttatataaatggttttccctgcgatatcgatatcggagacttttaatgaagtcaactcactcacacgtaggccatgaatataagttaagtacagcagacactgatcgcgctctttatttgtagcattgtttaatacagaaaaaaacacgattccattcatcttgtgttatgtattttctcatgactatctccaataaaacgaacccagcactactttaatttaatacattctgctcaagcagaatgtcggcacaacaaaaatatttttatgtttcccgttttatggcaataaactaccctctgatcaatgagcatcagtaaataatggtttggagatcatttttgatctattgcgtcaagctttttagctttagtaattatatgacctgtgtgagattttgcagaatataaataaaatctaaagcacaataagcacaataagcacaataagcacaataaataattgtaaagagtaatgaacagtgtagccatgcttacataataaattattaatgttattttttgtctattttttgatctcgaaaataacgcaatactcattgtttgaacgtgagagataaaaaaataattttaacctatacgtcaaatagaacaactcatagacaaaattggcctgtctgtcattggtaaatgaaaatgaaaacgaaaattagtagcaattaatcacactgttttaattgaccatatttacttatatttaaaattgtttttattttatcctatccgggataccgagccaattgagtgattaatttataactatatgttttaattaaattaattaaaaaaccatgtctttaccatcaaaatatactattcataaagctatcaaatccttcttattgatttccattatatttaatatgtttgctaacgaaagttatattgatcaaaaaatgattttatgttggaataaaaatctacatataagacatatatcagccaaataacccaatcattaactaattaatagattttgttaactgccttatgatgtatcaagtcagccaatgtcgtgtggtcaacattctatttcggcattactggcgtttttttattgttataggtatagctatgcacagaaaattcgataagtcgtggccgcagaatcagcctcccctgctgaaacgaatggcttgggcgaacattatcatccaactgacgttaccggtagcaggtgcatttacccccattatcgccgcagccaaaacgcatacgacttctcacgatcaacaattgacggcactaccgacaaaaccttatatcctgaaatccggggaaacgatcgatttaatagctaaacgttatagcttaaccgtcgatgatctaaaaaaaatcaatcaattgcgtacctttagcaaatccttttcaacattgggtatcggtgatgaaattgatgtaccccgacctcgcctcaataagtttctaccttttaattattctccgttagacgaatctgacagcaaagatgggacaaatagccgtctgtctaatgccgccattcgcgtcggcgatgtgctgaaaagtaataacatcagcaatagcgcaaaaatccagttaaacggtcttgcagtcagtgaggttaatcagcagatacagaattggctgggacactacggcactgcacgggtacaggccaatataagtgatcggggccgattagatggcagccagcttgatatgctgctccctctgtatgatacaaagagccagctgactttcacccaattcggcctgcggcggctgaataaacgcaataccgtcaatctcggtgttgggcaacgccgtttctttgacggcggaatgctgggatataacgccttttttgaccatgactttaccggagaaaatacccgatgggggattggggctgaatatgcccgcaattatctgaaattgggtgctaatggttacttccgcttaagcaattggaaagaatcccaccttctgaccgattacgatgagcgcccggctaatggttttgatctgcgagttcagggctatgtacctaccttgccacaactcggcggcaagttgatgtatgaacattacttcgggagtgaagttgggttaatcaatcaaaatcatcgccagaaagatccttctgcctttaccgtaggaattaattatacgccgatcccattgctgactttcggcattgttcgaaagcagagtacttccggtggtggcgaaacccagttcaatatggagttgaactatgaaatagggacaccgtgggagaagctaattgatcccgatgccacggatttcaagcgcaccctacaaggcagtcgctatgatctggtcgaccgcaataaccagattgtgctggaataccgcaagcgtgaaattatccgcctcacaatggacagcctgattaccggacatgctggtgatatcaagccacttcaccttaccgtggacagtaaatatggtttgaaaaatattcagtgggaagccgtaaatctgtttgccgatgggggtgagatcgagcgccaaggcggctctcactatctgctgactctgccggaataccaccatcagggcaacaatacttatattctcagtgccgtggcctatgatgagcacggcaatgcttctcagcgggtagaaactcaagtacaggtgctgccagccgcagtacgtgacaataagtccactttcacagcaaaagataatgaactgctggctgatgaccgtgccaccaccatgctgaaattaaccttagaggataaagagggtaaaccaatccgtgatgttgccggcgatatcaaatgggttactaatcagttgagtggagaaggcagcgatccgacgatcggaaaaataaaagaaactcaatcaggtgtctatgaagccatactcacggccggcaaaaaaatagggatactgaaaattacgcctgaagtggatggagttcatatcaagccattaaaaatcacatttgtgcatcctgacgcaccgtttgtcaaaaatctgactattgttggtaaattggaaatcgggcaaaaattgagtgcaacttatacctttaaccctaatggtggcgaaaaagtggataaatcccgctatgtatggggtgacaaaggtaatatcgatattaccaatggtcatacgatcgtcgaatcaggcaagctccctaactatacattggaactgtcagatgcaggccgggtaaaagccgttgcagtgcaggcacaaaatggccttggactcatcgggaatactatgattgttaataccagcatgagccaagagagtggcaaccgtactcacggtggcagtgaaggcggaaaagtcagagggattgcggatgatatcgctgccacagtgaatactgataatactaaaaaaagcaacgcaatcactttgaccgtaaagacattcaaacacgggcaacccgtcagaaatgtggccgttgaggtgcaagcgacccaagcaataaaccgccagaataaacctcagacgattaccgtgctgataggcggcaaacctgctctctatcaaggcgtgacagatgagcagggcgtgctgtctattcctgtcaccgatccaaacgggaacggtgtaaaaaccgctcttaagataacagcatatggttctgcaaaacctaaaactcaggatctcatctttaccgtcccgaccagccccgatacccctctggcaaacttttggggacatatgtccgaatcagtaatgggtgccaatggcgctgtctttatgcgcccccagttgcaaattgaactgaaagggaatatgaaagggatggccacattttttgaaagcggtgaaatatggccgcgtcgggtttacagaggagctaaatggtactgcggaaaaatacatgccaatttgccaacacaagaggatttgcagagcctgtatcgtgcatattcggcaaatgaaatgcacgatctgcacggctggccacaacaccgctcttatcgttcttcaacgcctgcagagggtaacaaagtgcatattgccgtgaatatagacaatggaatagcacatcccatcgaggacaacattgtcagcgattatgtcatttgccgtcagtaaaacaatgaatatttgacatacaaatccgcctctcaaaggggcggatcaccctctctcttctcaacagaatgattttctcttcccaatgtcctattgacgggcttaaattcaacctttgataatggagatctaaatttatttataaaaattaatcacgcaatgaaaatagaaaaatatgcatgaatttaatcttgttttgttactacttcagcaaatgtgtgtctatttggttatcgcctggctgctgagtaaaacgcctctgtttatccccctgctgcaagtttccgttcgcttgccacataagctgatgtgttatctcattttctccattttttgcattatggggacgtattttggattgagtgtcaatgattccatcgccaatacccgcgccatcggtgctgtactgggtggctttctcggcgggccggcggtcggtgctatggtaggattcactgggggattgcaccgctattccctcggtggaatgaccgcgtttagttgtatggtgtccactattgtagaaggcatacttggcggccttgtgcacagttatctgatgaagcggggacaaatcaataagctgctgaatccgtggactgccgctatcgtcaccttcctggctgaatgtatccagatgggcattatcctgctgcttgccaatccgttcagtgatgctcttaagttggtgaaaaatatcgccgctcccatgattattgccaatagcatcggagcggccatgttcattcggatactgctcgacaggcgcgccatctttgaaaaatataccagcgccttttctgcccaagccctgaaaatcgccgtctgtacagaaggaatactgcgtaaagggttcaatgaggataacagtatgcgcgtagcaaaggttatttatcaggagttagaaatcggggcggttgcaattaccgacagggaaaaattactggcgtttatcggtatcggctccgatcaccatttgtctggtactcccattgtttccgagcaatcacatcgtgcgatagaaaataatgaagtcgtgtatgccgatggtaatgaaacgccctattgctgctctctcagcccaatctgtaaactcggctcggctttggtgatccctttacggggagaaaaccaacaggtgattggcaccatcaaactttatgaagccaagaatcgtctattcagttcaatcaatcgtacattaggtgagggcattgccagcctgctttctgcccaaattcttgccggacaatacgagcggaacaagcaatctttgctgcaatcagaagtgaagctacttcacgcgcaagtaaatcctcactttttatttaatgccttaaatacgttacaggcggtgatccggcgggatagccaacaggccgggcagcttgtgcaatatctttcaacatttttccgcaagaatctgaaacgaccagaggaaattgccacgctggagaatgaaatagagcatgtgaatgcttacttacaaatagagaaagcccgtttccgtgagcgtctccagattgccatagcaatacctgaatccctgcacagcgcaaaattgcccgccttttccctgcaacctatggtagaaaacgccataaaacatggcacttcacagttactggatacaggccgaattactatccgagcccatcaggaagctaatttattactggttgagattgaagataatgcaggactttattgtctaaaaaaaatgggggatggacttggaatgagtctggtagataaacgtcttcagcttcgctatggtgagcgctatggtgtgcatgttgattgccaaccagaaaaatttacccgtgtcattttatgtttaccattggaaaaagaagctgacaaagcggtgtaagtatgaatgtattgattgttgatgatgaaccactggctcgtgagaatctgcgttgcctgctagaagaggaaacggatattcaaatcatcggtgagtgtgccaacgcagtggaagcgattggtgctatccatcgcctgaaaccggatgtggttttcctcgatattcagatgccccgcattaccgggcttgaaatggtggggctgcttgatcctgagcatcgcccttatattgtttttctcactgcctttgatgaatacgcagtgcaagcctttgaagaacacgcgtttgattatttgctgaaaccgctggaaaaggagcgtctgagcaaaacgttgcagcggctgcgttcaggctatcagaagcaaaatctggcagatctgcaacaggaagatgagcagcttaaatatattccctgtacagggcacagccggatatggctgatgcagctggatgaggtgctgtatgtcacctcacgcctgagtggagtttatgtgatgagcgctaatgaacaggaaggttttaccgagttaaccctgcgcacgctagaaacccggacttccttgacccgctgccatcgccaatatctggtcaatatgactcatttgcgggaaatcatttttggagagaatggacaggcagaactggtgttacgaaataatgagcgtattccagtcagtcgccggtatttaaaaccactaaaagaagttctggggttaaattaatcatttttccgggcgaaaacatcgggtacttatccacccgctggatcaaaacgaagggggactctgttccgtagaagaacgtgtgctgttagaaatggttcatggtggctttcaagccagaacaaagaaagtcgtcattcatcaaagtgagcgcttactttcagatgtcgaggccaagaatgtgctgaacataagctgatgggtattgatgaaatctaaatgttaatgttacttcaatattaaaaagccccttctctattaggaaaaggggctttatcttcaaggcattatttcaatgcactttgtcttataagcttatgcgttgccgctgttttgacgacgacgtggtgcgctattgctctcatcaccactgcggccacgggaattagcgcgatcgccacggcgttcagtgctaaaacgacggccaccattaccaaagccttcacgatcacgacgtggagcattaccgctgttgctaccgttaccgccagtgctaccattaccgctattgctaccgttgctaccgttgctaccgttgctaccgttaccagtacgaccactaccaccgccacgacgttcgcgacgttcaaacggttgtgcatcacccatcaactgcatattcagtggcttgttcaggatgcgggtacgtgtgaagtgagacaataaatcccccggcattccttttggcagctcaatggtggagtgagtagcgaacagcttgatgttaccgatataacggctgctgatatcaccttcgttggcgattgcaccaacaatgtgacgcacttcaacaccatcatcacgacccacttcaatacggtacagttccatgtctcctacgtcacggcgttcgcggcgcggacgatcacttttgtcgccacggtcgtttctgtcacctctgtcatttctttcacgactgacgaaaccatcacggcgacggtcatcacgatcattgaattcacgacgaggacgacgaactgggtctggtggcagaatcagtgggcgctcaccctgtgccattttcagcaatgacgctgccagcgtttccatatccagctcatcgttagtgctcagtttagacaacagtgcacgatactgatccagatcgctgctttccagttgctgctgaaccttagccgcaaatttctccagacgacgctggctcagaagttctgcattcggcagttcaacttccgggatggtcagtttcatggtacgttcaacgttacgcagcagacgacgctcgcggttttcaacaaacagcagagcacggccagcacgaccagcacgaccagtacggccgattcggtgtacatatgattccgcatccattgggatatcgtagttcacgaccagactgatgcgctcaacatccagaccacgagccgctacatctgtcgcaatcaggatatccaaacggccatctttcaaacgttccagtgtctgctcacgcagcgcctgattcatgtcaccattcaatgccgcagagttataaccatgacgttccagggtttctgctacttccagcgttgcatttttggtacgcacgaaaataatcgtagcgtcaaaatcttctgtttcaaggaaacgtaccagtgcttcgtttttacgcacgccatgtacagaccagtagctctggctgatatctggacgagtagtaacactgctctgaatacgaacttcctgtggatccttcatgaaacgacgagtaatacgacgaatcgcttcaggcatagttgctgagaacaaggcagtctggtgctcagcagggatctggctcatgatgttctcaacatcttcgataaagcccatgcgcagcatttcgtcggcttcatccagtaccagacctttcaggttggacagatccaaagtaccacgcttcaggtgatccagcagacgacccggcgtgcctaccacaacctgtggcccttgacgcagtgcacgcaattgtacgtcgtaacgctgtccaccgtagagtgcaacaacgtttacactacgcatttgcttggagaactctgaacatgcttcagcaacctgtaccgccagttcacgggttggcgctaacacaaggatctgtggagctttaagctcagcatcaatgttgtgcagcaaaggcaaggtaaatgctgcagttttaccactaccggtctgtgccatacccagcacatcacgaccgtttaacaggtgaggaatacattgttgttggataggggaaggcttctcatagcccatgtctcccagtgcagcaagaataggtgctgataaacctaaatcagcaaaagagatttcagtctcagtggtcatgtaatggtgcctcattaatcgtggcggccagtctacataacacagtgaaaagaatttctgtcattttcatttaaaatgtgaactggctcaaattatgttattaaacgaacaaacaagcccccacctatcaagatgtggacttaaaaatctgtcatgaaaatgttcgtcagctattgttggttcgattccgataggtcatcttgtctctggcctagcagcgctaattccaacaatgcatagcggtgctcaacaaaattatggacattgttagctaccgtcagcttgaataacgcaaccgcgttatcctcatcccccagacttaggtaatgcttacctaaatagaagtcagtttcactgagatgctcagcgagcgaagtgttatctgatgaattctccttcaggcgatccatcagtgttttctcactgattttgcctaaatagaactcaacaatattccagccccatagcccccggttcgctttgtcaaaatggcgtgacaaattggtcattgcaaccttgggatcgattttatcttccacaaggtacaaccacaacgaacggaagggatcatttggatcgtcttgataaaacgcctgcagatcatcctgcgctaaacgatagcggccaccataatacagtgtaatgccgcgattcattcgcgcgtagttgtaagttggatcaagctctaaaacagaatcaaacgcttcataggcagcatcaaaattgcctgcctgcgtaaaataaatccctaagtaattgaaaatttcgggaatatcaggacggatagacaaagccactgaaaaatcattctgcgccaatgccctcagcccgaggctatcatacagcacacctctctcatataaaagctgtgcatactcatcttccgtaagcgagcgactggcaagtatttgttccatacgagccaggatgacctcttgttgcaatgtcggttgtaatggaatagcaatcatttcatttttacgccatccagtgctgctacatcccacaaggagaaagataaccgcaacataacaccagcgcagaaaagaattcatttcctactcccgaagtcagacattaatcagaatgccctgttactccacccacattgtatatttcaggcgtcctgcccaaaattgactaaacggcgccctttttacaggacgccgttctttacgtcaaatttattctactgatgattccggtgattgtagtgcttcatcggtagtggtattggtcacagcttctttcatgctcagacgaatacggccctgacggtcgatctccagtaccttgacaggcacttcctgagcgagttgcagatagtctgtcactttctcaacacgcttgtctgcgatctgagaaatatgtaccagaccttctttgccaccaccaatagcaacgaacgcaccgaagtcaacaatacgggtcactttaccattataaatgcggccaacttcaacttcagcagtaatctcttcgatacgtctgatagcgtgatgggctttatcactgtcagtggctgcaatcttcacagtaccatcatcttcgatttcgatggttgtgccagtttcttctgtcagcgcacggatcactgaaccgcctttaccaatcacatctttgattttgtctggattgatcttaatagtgtggatgcgtggcgcaaattcagagatatcattgcgtgggctttggatagcctgttccatcacgccaagaatgtgcagacgagcacctttggcttgattcagagcaacctgcatgatttcgctggtgataccttcaattttgatatccatctgcaatgcgctgataccatcacggctacccgcgactttaaagtccatgtcacccagatgatcttcgtcacccagaatatcagacagaacaacaaagttatccccttctttcaccagacccatagcgataccagcaaccgcagccttaatgggtacaccagcatccatcagtgccagtgaagcaccacagacagaagccatagaagaagaaccgttagattcggtaatttcagaaactacgcgaatagtatatgggaattcgttggcggttggcattacagccagaacaccacgtttcgccagacgaccgtgaccaatttcacgacgttttggtgagccgaccatacccgtttcaccaacagagtacggagggaagttgtaatggaacaagaagcgatcggcacgctcgcccatcagttcatcaataacttgggcatcacgctcagtacccagtgtcgctgcaaccaacgcctgagtctccccacgggtgaacagggatgaaccgtgagtacgtggcagtacaccagtacgaacgtccagcgcgcgaaccatgtctttttcacggccgtcaatgcgaggctcaccacgcaggacacggccacgaacgacgtttttctccagaacagacagcacgtcaagaacttctgatccttccagttcaacacctttttctgctgcttctgtaacgataatcgcagaaacttcttctttgatggcattaacctgagcgtaacgttcctgtttttcggtaatacggtaagcatcacccagacggctttctgccagttcagcaacgcgatcatgcagtggctggttgatagattctggtgcccagtcccacttatctttacccgtttcagcaactaatgcattgatgtgatcaatcacaatctgctgctgttcgtgaccaaagacaacggcacccagcatctgctcttcagtcagcagctccgcttcagattcgaccatcagtaccgcgcctgctgtacccgcaaccactaaatctaaacggctgtttttcagttcatcactggttgggttcaacacgtattgatcgttgatgtaaccgacgcgtgcagcaccaattgggccattgaatggaatgcctgacagtgccagtgcagcggatgcaccaatcatggcaacgatatcagggttcaccagtggattaacagaaacaactgtcgcgatgatttgaacttcgttcagaaaaccttctgggaacagtggacgcagaggacggtcaatcaaacgggcaacaagggtttcaccttcacctggacggccttcacggcgaaagaaacttcctggaatacgaccagcagcgtaggtacgctcctgatagttaacggtcagtgggaagaaattctgacctgctttcatttttttctggccaacaacggtaacaaataccgcagtgtcatccatatttaccataacggccgctgtcgcctgacgagccatcatgccggtttcaatggtcacggtatgctgaccatactggaatttacgaacaatcggattcagcaaaatcatattccttggttagtgttgccgactctaaatatcagcaacaatagacattctctttttgctacaccctcacgactaatgacaacacttaattcccttaagcactctcattagccgcgcgagtccctgtagcggaagaggttaaaatttcagaaacagaacttaagtttttaacgttccgcttcccgcttcgcttcctagaagaaaaggggccctattaggccccttttcactgaaactcatcaattagcgacgcagtcccagacgctcgatcagtgcagtgtaacgtgcaagatctttacgcttcaggtagttcagtagcttacgacgctgtgcaaccatgcgcagcagaccacgacggctgtggtgatcttttttgtgctctgaaaagtggccttgcaggtggttgatttgagcggtcagcagggcaacctgaacttcgctagaaccactgtcgttagtgccacggccaaactcagcaacgatttgcgcttttgcttcagtacttagagacatagtataactccaaatataaattaaaaatcatgagtgccaatctctaattcagcaactcatatatagacgcgctattctacgctgcaaataggtgaagcgcaagacagcccagtgatcaccatttccatgctccagtacaatttgtctgtttcttatctatgccaaattgcctgttttaaaccacacacaatttatgcgattggtttttatagttgttctgtttctaccaccagacgacgcggagctaccagaccatcatcatcaatcactgcgatgccgatgaatttgttttcatccccttcagtgactcgcacccattcaccggacgttaaactgtgtttaccgcgaactggctgcccctgcttaaaataagcagcaacaactgatgccaactgaatgactggaaaatgtgcaaccgctgtatccattggcaataacaatgagtcgagcaattctcccgcatcaatctcttgctcttcagattgtttttttaattcatgcaactgttccagtgtcaccattctatgagtgggataattggcaacctgcaaacggcgcagataaatcacatgcgcaccacagcccaatagctcgcctaaatcatcaatgatggtacggatatacgttcccttggaacagtgtatttccagctctagctcatcaccttcccagcgaatgaactgcaattcgtaaacagtaatcggacgcgcttcccgcttaatttcaattccctgacgggcatattcatacagcggttttccctgatgtttcagcgcagaatacatggaaggaacctgcatggtatcaccacggaatgtatccaatgcggctgcaagctggggctgggtgatctgcacttcacgttcacaaatgatttttccatgtgaatccgaagtgtctgtgcgctgtcccaaacgggcaattacccgatagcgtttgtcagaatccagcaggaactgggaaaatttggtcgcttcaccaaggcaaattggcagcattccggtagccagtggatctagtgcccccgtatggcccgctttgctggcattgaagatccgccttactttctgtaacgcatcattagaggaaatatcctgcggcttatccagcagcaatacgccgtgtatcgcacggcccctacgacgacgccccatcacttttcctcgttgtgatccgcagaaacacgacgctgctcatcgtttttcacgactttagtaacaaggttcgacatgcgcattccgtctaccagagagctgtcgtaagagaacgtgagttcggggataacacgcagacgcatagctttgcccagcaaggaacgaataaaaccagaagcttcattcaaggccttaatgcccccgttgaccatctccgaatcttgtccttcgaccagcacattcagaaaagttacaaatactttggcataagccagatcacgagaaacctcaacaccagagactgttgccataccgatacggggatctttaacttcgcgctgtaaaatgatggcaatttctttttgcatttcctgtgcaacgcgctgagttcgactgaattctcttgccattgttttatctcctgacattttggggggcataaagccccccaagaatggaatgaatctatgatggtattaaacgatggagcgtttgatttcaataatttcaaagacttcaatcatgtcaccaacacggacgtcattgtagttcttcacaccgataccacattccataccattacggacttcgttaacgtcatccttaaagcgacgcagggattccagctcaccttcgtagataaccacgttgtcacgcaggacgcggataggattattacgcttgatggagccttctgtcaccatacagccagcaatagcaccaaacttcggtgatttaaagacatcacggacttctgcaagacccatgatctgctgtttgtattctggcgccagcataccactcattgcctgtttgatttcatcaatcagactatagataacggagtagtaacgcagatcaacactttcgctttcaatgatacgacgtgcagaagcatccgcacggacgttgaagcccagaatgattgcgttagacgctgcggcaagagtcgcatcagtttcagtgatcccgccgacaccagaaccgatgattttcactttcacttcatcagtagacagtttcagcagtgagtcgcagatcgcttcacatgtaccctgaacgtcggttttcaggacgatgttcagttcagataccttaccttcttccatgttggcaaacatgttttccagtttagatttctgctggcgagccagtttcacttcgcggaatttaccctgacggtacaaggccacttcacgagctttcttctcgtcacgtaccacagtcgcttcatcacccgctgacggtacgctggaaagacctagaatttcgactggaatggatgggccagcagacatgacttcaaagccaagttcgtcacgcatcgcacggatacggccatactcaaagccacacaggacgatgtcgcccttattcagagtacctgattgaaccagaatggttgcaactgggccacggcctttatccaagaaggattcaatgaccacaccattagccataccagtacgcacagcgttcagttcaagcagttcagcctgtagcagaatagattccagcaattcatcaataccgatacctgctttggcagaaacgttcatgaactggttttcaccaccccattcctcaggaatgataccgtattgtgtcagttcattcttgacgcgatctggatcagcgtctggcttatcgattttgttcacagcaacaacaacaggtacattagctgccttggcgtgctggatggcttccacggtctgaggcatcacgccatcatccgctgcgacaaccagaactacgatatccgtcgccttggcaccacgagcacgcatagaagtaaacgcagcatgtcctggggtatcaaggaaggtgatcatacctttttcagtttgtacatggtacgcaccgatatgctgggtaatgccacctgcttcgccagaagctactttagtagaacgaatgtagtccagcagtgaggttttaccgtggtcaacgtgacccatgatggtaacaacaggcgcacgtgattcagccagcgtttcacctgtgtcacgatcgctcatcagcgcttcttccagttcgttttcacgacgcaggataactttgtgccccatttcttcagcaactagctgtgcggtttcctgatcaacaacttgattaatggtcgccattgcgcccatcttcatcatggtcttgataacttgggaacctttgaccgccatcttgttggccagttcagctacggtaatggtttcaccaatcacaacatcacggttaactgcggcaactggcttggtgaagctctgctgtaaggtactcggtttacgctgtttgcctttggtacggccgactgcacgtgcttcttcgcgatcggctttcgattcagaatgtttgttattcttcttctggcgggtagctttgccgccacggctacgggtacggcgatcgccttcaactttagcgtcattttcgtcttccgcagcacgggcgtgatgggaagtggttacgtgataatcatcagtactttcgctgggttcagcggtttctgaccatttatctttattttcttctgccatgcgacgtgcttcttccgcgacacgtttcgcttccgcttcaactttgcggtgcacctcttcttcagctttgcgttttaaatctgctgcttcggcttcacggcgcgctttttcactttgcacggcaggctcagtctgaactgattttggtttgttttcggtatgttgcttagtcactttttctttttccgccgcctcacgctgagtcatttcaaccccttcgcgtttagctttttcttctgcttcacgttgagcgctctttgctgcttcacgttttgcctgttcttcagcatcacgtttagcttgctcttccgcgaattttttcgcttcagtttcaagccgcgccttttcttctacctcgcgccgagcctgctcttccgcttcacgcttcgcctgttcttccgtttgagattgttcaatcgcgtcacggttcacatatgtgcgttttttgcggacttcaatcgctaccgatttacttttgccaccggtgccaggaacgtttagtgtactgcgagtcttacgctgtagtgtcaatttacctggctggccgccagaaccaccttgttcgcggttcaagtgtgccagcaaagattctttttctctctgggaaacagagtcagttgcggttttctgaatgccagcatcagcgaattgctggatcaggcgttcaaccgatgtctggatctcttctgccagtaattttacggttacctctgtcattctgttccttcctgctacagtttatttatgcatcatcgccaaaccaacagatattacgggctgccataatgagttctcctgctttctcatcactcagtccttcgatatcagataagtcgtcgataccctgctcggcaagatcttccagagtacagatgccatgggcagccaggttaaacgccaaagtacgatccatgccagataaattcaataaatcttcggcaggttgctgatcaccaaggctctctttctgagccagttccagcgtcgtcaaggccgcttttgcacgttcacgaagaacttcaacggtttcctcatcaaggccttctattgccagaagttcattgattggcacataagccagttcttctagcgtagagaagccttcctcgaccaatacggtggcgaaatctacatcaatgtcgagatgcttggtaaatgtatcaatagaagcatgtgcttctgcctgatgttttgcttgcagctcttccgcagtcatgacgttcagttcccacttgtcatcaccacgatgttttttcagcagttgtgccgccaggcggacgttttgaccattacggccaatcgcctgagcaagattgctgttttccacggcaacatccatcgtgcagttatcttcatcaactacgatagatgcaacatccgccggagccattgcattaatgacaaactgtgcagggttatcatcccacagcacaatgtcaattctttcaccgcccagttcgctggaaacggcctgtaccctcgcaccacgcatacctacgcaggcaccaactggatcaatacgtttgtcgttggtttttaccgcgattttcgcgcgagaacctggatcacgggcggctgctttaatctcaatgatctcttcgccaatctcaggcacctcaatgcggaacagctcaaccaacatctcaggacgagagcgggtgatgaaaagctgtgcaccacgagcttctggacgaacatcatacaggacaccacgcacacggtcacctggacggaagttttcccgtggcaacatatcttcacgtaaaatgaccgcttcagcgttattacccaaatcaagggtaatattctcacggttcactttcttgacctgagcagtcacgatctcaccctgctgctcacggaactgatcaaccaccatcgcacgttcagcttcacgtactttctgtacgataacctgttttgcggtctgggtcgtgatacggtcaaaagttactgattcaatttgatcttcaatataaccacccagttccatttctgggtcttcatattttgcagcttccagcgtgatttcgcgggttggcagggttacttcatcaaccgccacccaacgacggaaggtatcgaaatcaccggatttacgatcgatgcaaacacgaacgtcgatttcctgctcatactttttcttggtggctgtcgccagtgcaatttctaatgcttcgaagattttttcgcgggggagagatttttcattagaaaccgcttccacaacagccagaatttctttattcatcctagttgcctcatccgaactttaaaagtggggtaccaggttcgctttctggatgttgctcagtgcgaacacttcgtcttttccatccaccgtaaccgtaatcatttcaccatcgacaactttgataataccttgccatctacggcgattctgcattgccatacgtaaaaccagactaacttcttcacccataaaacgctggtaatgttcagccttaaacagtggacgttcaagtcctggtgaagatatttccaggttataaagcactgagatcggatcttcgacatcgagtactgcactgacctggtggctcacatcagcacaattatcaacagtgataccctcctcactatcgatatagacccgcagtgttgatacacgtgcacggataaactccaggcccactaattcaaaccccaaagcttcaactggtgctgaaatcatcgctgttaatttttgctctaatgtggacaagcccacccccaagacataaaaaaagggctatattagcccagtagttctgctgtcaaataacaaaaaaccccgatactcggggctttatgcaactggaccctgtttactgccagtggtctcaaccaacttcttttatacctatcaaaacaacctttcaaatcaggatcgatatctctatggctgctgaattatgactcttgaaaaggtacatgttgttaagaagtggttgcgggagccggatttgaaccgacgaccttcgggttatgagcccgacgagctaccatgctgctccatcccgcgttcgaaaacgtggcaaatcttacgctgataatactaaaaacgcaagtttctagattatggtgccgaggacgggacttgaacccgtacgcccgttgtttaggcactaccacctcaaggtagcgtgtataccaatttcaccacctcggcactgattatagaactgttatttcaacctgtcgcttatacttactggttaaactaacaactccattttaattcttttactgaaaattactgtgggatatcactatttggttttactggcgatgctggtacttctgcttgtttttcgacttttacaggctcagcaagattttcccacttactgtctgaaccagttcggttactggtcatgttacccagaatcaaactgataacaaaaaacaatgtagcgaaaacagccgtcatacgggtcataaaattactagagcccgatgaaccaaacagtgttgcagacgcacccgcaccgaaagaagcacccatatcagcacctttaccctgctgtagcagaaccagagcaatcactccaagaccagctagcaagaatacacctaaaagagcttcatacatatgtcgtacccgttttctcgtggggatttaccacaattctgtagcaacgttatactgcatcacccgctcataattagaaaaattaacttattgagcgggtgtgaatactaaccaaagcgtttcagacaagcaaggttaatttcaaatactggcgttgatcgaagaaaaaatcaacaaatcatcctatttttttcacggcatcagcaatacggtgtgccaatgcagtgaccaattcttcatcttcaccttccaccatcacacggataagtggctctgtacccgatttacgtagcagtactcgaccacagccgttcaattcagcctcaaccgatttaacggcttctagcacaggttctgattgcaaaggatcgttgtcacccgtaaaacggacatttaccagaatttgtggcagaagtttcataccgctgcacaggtcatgcaggctcatattattccgtaccattgcgctcagtacctgcaatcctgccacaatgccatcgccagtcgtggttttgtccagcaaaatcacatggccggaattttccgcccccagacgccaacctttttcttgcaatttttccagtacgtagcgatcgcccacttttgctcgctcaaatgggataccaagctgtttaagcgctaattccagccccatattgctcatcagagtaccaaccgcaccaccgcgcagttgcccctgtctcaatgcctcacgcgcgatgatatagaggatctggtctccatccactttctgtcccagatgatcaaccatgataatgcgatcaccatcaccatcaaatgccagaccaacatcagcctgctcttcctgtacccgcttctgtaacaggcgaacatctgttgcaccacactcttcattaatgttgatgccattcggctcacagccaatggtcacaacatttgcacccagttctctgagaacgttcggggcaatatggtaggttgcaccattggcacaatccaatacaactttcaatccattcaggctttgttcactcgggaatgtgcctttacagaattcaatgtaacgaccagccgcatcaacaatccgattggcacgccccaactcagcagactctacgcaggtcagtggtttttccatttcagcttcaatggcttcttcaacattatcaggcagtttggttccatcgatagagaagaatttaataccgttgtcatagtaaggattgtgagaagctgaaatgacaattcccgcttctgcgcggaaagtacgtgtcaaataggccacagccggtgttggcatggggccagtaaaagatgccgataaacccgctgctgccaaccctgcttctagagcagactccagcatatagccggaaatacgcgtatctttaccaatgataattttgcgagaaccatgacgcgccagtacttttcccgcagcccaaccgagtttcaaaacaaaatcaggggtaattgggctatcacccactttgccacgaataccatcagtaccaaaatatttacggctactcataaattttttcttcctttgctgaacgtgttctttgctcacagcgtgttcttggcagccagtgtgtttttcgctgacagtgttgcctgaacaatttgcattgtctgtacagtttcttttacatcatgcacacgaataatctgggctccttgcatcgctgcaatcacagcgcaggcgatgcttcctgtcacacgctcctgcggtggtacatgaagcaattggccaatcatcgatttgcgtgacattccagccagaataggcaagccaagatgatggaattcttccaaatgagccaatagctgataattatgcgataagttctttccgaagccgaagcctggatcaatgatcagtttgttttttgcgatgcctgccgcaccacagcgatcaatctgcctcgtcaaaaatgttttggcttcccaaacgacatcttcgtagtatggctctgcctgcatcgtgcagggctgtccctgcatatgcatcaggcaaacaggcaatcccgtctttaccgctgcgtcaagtgcaccaaactcctgcaacgaacgaatgtcattgatcatatgagcaccgactttagcagattcctgcatcactatggcttttgaggtatcgatggagatccatacatcaaagcgctgcgccaatgcttcaaccacggcgacaacgcgatccagttcttcctgctcactcacatccacggcaccagggcgtgtcgattctccacccacatcaataatggctgcaccttcctcgatcatggtggctgcgtaccgcagcgcggcatcaaaggtattgtgattgcctccatctgaaaaagaatcaggagtaacgttcagaatccccatcacttgtggacgggaaagatcgaggacactgcctctggctgtcagtttcatcgctagggggccttaatgtcaaaaccccaggaagacctggggtttaataagtacagtctgtcaaatccaagggcaacagcctgtaattgcccttgatttgataaaggttgttaactgcgttatgcggttggattaccatccgcaggtttcacagtctgctgcggggatgacgtattatgacggttattaccgccattattgttgtcaccttcccaacctgctggtggacgtactgttgttcgattcatcaagtcatcaatctgaggtgcatcaatggtttcatacttcatcaacgcatctttcatcgaatgcaggatatccagattatccatcagaattttacgggcgcgttgatagttacgatcgacgatagctttcacttcatgatcaattaaacgcgcagtatcttccgacatatgtttcgctttagcaaccgaacggccaaggaagatttcgccttcttcttccgcatacagcagtgggcccagtttttccgagaagccccactgtgtcaccatgttacgggcaatggatgtcgccaccttaatatcgttggatgcgccagtagaaacactgtctacaccgtagataatttcttctgccaaacggccaccgtataatgttgaaagctggctttccagtttctggcggctcgcgctgatctgatcaccttctggcaggaagaaagtcacacccaacgcacgaccgcgaggaataatcgtgactttatgaacaggatcatgttctggtactagacggccaatgatggcgtgtcctgcttcatgataagccgtggattctttctgctcttccgtcatgaccatggaacggcgttctgcacccatcatgatcttatcttttgctttttcaaactccaccatggaaacaacacgcttattgccacgagcggcaaacaaggcagcttcgttcgcaaggttcgcaagatccgcaccagagaaacctggtgtaccacgagcaatgatggaagcgtcaacgtcggtatccagcgggatacgacgcatatgcactttcagaatctgctcacgaccgcgaacatctggcaggccaacaacgacttggcggtcgaagcgacccggacgcagcaatgcagggtccagcacatcaggacggttagttgcggcaataacgatgatgccttcgttaccttcgaaaccatccatttcaaccagcatctggttcagtgtctgttcacgttcatcgtgtccaccacccagaccagcaccacgttgacggcctacagcatcaatttcgtcgatgaagatgatacaaggcgcggattttttcgcctgttcaaacatatcacgaacacgggaagctcccacaccaacgaacatttcaacgaagtcagaaccggaaatggtaaagaaaggcactttagcctcacctgcgatggcttttgccagcaacgttttacctgtaccaggaggaccaaccattaagatacctttcgggatcttaccacccagtttctggaaacggccaggttcacgcagatattccaccagttctcccacttcttcttttgcttcatcgcagccagcaacatccgcaaacgtggttttaatctgatcttctgtcaacatgcgggctttgctcttaccaaaagacatcgcccctttaccgccaccaccttgcatttggcgcataaagaatatccagacgccaatcagcaatagcattgggaaccaggaaataaagagagtcgcgagcaggccctgttgttctggtggttcaccaacaactttcacctgcttattcagtagagtatccagcagcttctcatcctgaattggcatgtaagtgctgtattttttaccgtcgtctttcttactgtaatcaatatcacgacccgatatacgtacttctcgcacttgattctgagataactcactgatgaaattagagtaatctaccctgcgaccgctagaatcgccaggaccaaaactctggaacaataccatcaagacaactgcgatgactaaccagagaatcaggtttttcgccatgtcactcaagggattaacctcatattacaactgtgttaacaaatagtagtcagggtactacagtttccgccctgtcgctacaatgtatacttcacgcgatcgtgcccgcgaagcttctggtttacgaactttaaccttcgtaaaaagggagcgtatttccctcaggtattcatcaaagccttctccctgaaacactttaacgataaaactaccgccaggggccagcacatcacgacacatacctaacgctaactcaatcagatacatggatcgaggaatatcgaccgcgggggttccactcatattgggagccatatccgacatgacgacctggactttattatcacccactctctcaagcaatgctttcaatacaagttcatcacgaaaatcgccttgaaggaaatcgactccaacaatcggatccattggtaaaaggtcgcaggcaatcacccgcccacgatcaccaatctgactgactacgtattgagaccaccctcccggagcagcgcctagatcaacaacggtcatacccggtttaaagattttgtcgctttgctgtatcccatcaagtttaaaccaagcacgagagcgaagcccttttttctgcgcctgaagaacatatttatcactaaaatgttcctgtaaccagcgactggagcttgctgagcgttttttattggccattgttctttccaactatacgaatagagagctatatttttgcactctcctatcaaatcacgccatacttttatggtgatagatacgagatggcggtagaataggccgttttcaatcccaacataagcaaaaaaacgatgactcttaacaagaaacaagtgcaatacctgaaaagtctcgctcattcattaaaacctgtcgttatgattggtaacaacgggctgactgaaggcgtgttggctgaaatcaagcaaactctttcgcatcacgagcttatcaaagtcaaagttgcaggcgaagaccgtgaaatcaaaactttgatcgctgaagcgattgttcgtgaaactggtgcatataatgtgcaaatcattgggaaaatgctagttctctaccgtccatcgaaagaacgcaggattagtttaccgaaataatcacagcatatttatacaaaagtgccatatctaccatgataaaaaaggccatctcaggccttttttatttccatatcagcataatggccgcttgccacgatttctctgtaacagtttctcaccctcacaggcaagattaaactgtttcccaacatcagagatactcgacattcagaacttcatattccactttgccgcctggcgtactgatcacaacagcatcatccacttctttaccaatcagcccacgagcaatgggtgaattcaccgaaatcaggttctctttgatattcgcttcatcgtcacccacgatacggtaagtctgctcttcatcagaacccacattcaataccgttaccgttgccccaaagatcacacgaccattattagtcatcttcgtgatatcaatcacctgcgcattggaaagtttagcttcgatttcctgaatacggccttcgcagaacccttgctgctcacgagcagcatgatattccgcattttctttcaaatcaccatgcgcacgcgcatcagcgattgcggtaataattttagggcgacgtacatttttcagattttctaattcttcgcgcaatttatccgcgccacgtaccgtcatcggaatttgtttcatttatcaaacctctaaatcaatcctaaacccaaacaacatcttcctgatttttgcaataacagcacaatgagcacaccttatcaggcgggtctccagacaataaaaggagagcaaactacagtataccctgaagttcacatacctattttgcctgctaatctattattctaacgtagagttgatgatggatcatcgtttacttttacctgaattgcaccttagtattattgatgtaaatattattagaatacttccaccttcatatgcgagatctatggctcttttaaaaattaccagcaaaatagcttgtatgctcagttttagcctgagcattttcagcgcaaatgcgtcctcaatagaagaagatgctcaatatttgcctgcgggaactgacttctcatttattgcccagaaaatcggctcaaaaacgtccttatttgattataatgggcagcagttggcattacctgccagtactcagaaaattgtgacggcattggcagccttgttacagcttggcaaggattaccgttttatcaccacactggaaagtaatgctgatatttcagatgggatattgagaggcaacctaactgctcgctttgttggtgatccaaccctgacacgttcgcaactgcgcaatatggtagaaacgttgaaacaatccggcataaaacagattgatggcgatctcatcatagacagttcaattttctcaagccatgataaagctccgggttgggtatggaatgacatgacccaatgcttcagtgcacctccagccgccgcaattgtcgataaaaactgcttttctgtttcgctgtatagttcagaacaacccggtgaactggcgtttgtccgcgttccttctttttatcctgtcagtatattcagtgaagtaaaaacgctgtctaaaggctctccagaagcaaaatactgtgagctggatgttacctcaggtgaattaaaccgatttactctgacaggctgtctgacacagcgcagtgaaccactgccactggcattcgccatccagaatggagcaagttatgtgggtgctattttgaaaaatgaactgcacatcgctgacattgagctaaaaggccatctacggcgccaatcgaatcctgagcaaccagagaagattctcgctttgaatgaatctgttccattacatgatctgctcaaaatcatgctgaaaaagtcagataacatgattgccgataccatctttcgcaccctcggccatcgctattttaacgtacccggaacatggcggactggttctgatgccattcgtcagatactgaaacaaaaagcaggcattgatctaggcagtaccgtcatggttgatggttccggcctttcacgtcacaatttaatcacaccagcaaccatgatggaaatcttgcaatttatcgcgcagcacaatgatgatctcgattttatatccatgctgccaaaatcaggttatgacggtaccctgtcctatcgtccgggactccatgaagcaggtgtaaatggtcaagtctttgcaaaaacagggtcactgcaaggggtttataatcttgcgggctttattaccgcagccagcggacagcagatcgcctttgtccagtttatctcttcttattctgttttacctgacgctcaacgtacccgccgtgttcctttggctcgtttcgaaagccatttatataaatcgttataccaaaatcattgatcgaaaaagggcgcttaaaaagcgcccttttgtcattctagtacatcaggagtgaagatctagtgtttataaataaactcaatgccttcttcgtctccctcatcccagtcatcatccaaatcatcgtcaacatccgtatcagatgattgttgtaactgttccttatggtaatcatcccacatgaattcaactttttccggctgggcttcttcctccacgtccatatggcgaggctgagttttcatgaattccatgatgtcccagcaaagatctttcacaccctgacgatttatcgccgaaatcatataatagtcgccttcccagccaagctcatcagcaatagcttttgcccgctgtttagcttcttccggatcggttaaatcgactttattgaataccagccaacgcggtttttctgccagtttttcgctgtatttgtgcagctctttaatgatgatacgggcattttcaaccggatcagattcatcgatcgggcaaagatcaattaagtgaagtaagacacggcaacgctccaaatgtttcaggaaacgaatacccaagcccacaccgtctgacgcaccttcgatcaaaccgggaatatctgccacgacaaagctttgctcgttatccatccgcacgacgccaaggcttggcaccagtgtcgtaaatggataatccgccactttaggtttcgccgccgaaacagagcgaatgaaggtggatttacctgcatttggcatccccaacattcccacgtctgccagcagcatcagttccagcatcagctcacggctttcacctggcgtccccatcgttttttggcgaggagcgcggttaacagaagatttaaagcgggtattaccaaggccgtgaaatccccctttggcaaccatctgacgctgctcatgacgcaccatatccgcaaggacttccccagtcgcgatatcgcgcacacgggttcctactggtactttgatggtaatgtcttggccacgtctaccggtacaaccacggctttgtccgttttgaccacgttcagcacggaaggatttttcaaaacggtagtcaatcagcgtattgagattttcatctgccagcagatagacatcaccgccgtcaccaccatcaccgccgtctggcccaccttttggaatatatttttctcgacggaagctgacacaaccattgccaccatctcccgctacaaccagtatgctggcttcatctacaaatttcatcacttttctccgtaggataaccaccgtaaagctggatggctgctgtacccagagatggcgtaatccagaatataaaaagccccgcaacacacattgcagggcttccgattcgatttagactcaaaaaatttattcagctacgatactgataaacttacgattttttgaacctttaacttcgaatttaatttttccgtcagctaatgcgaacagggtatggtcacggccgcaacctacgttgctgcctgcgtggaatttagtaccacgttgacgaacaatgatgctgcctgccaaaacagactcaccaccaaaacgttttacacccagacgtttgctttcagaatcgcgaccgttacgagtcgagccgccagcctttttgtgtgccattaatctgctctcctaaaatcttaagcgatgccagtgattttaacatcagtgaaccactgacggtggccctgctgcttacggctgtgtttacgacgacgaaacttaacgattttaattttctcgccacggccatgagcaacaacttcagctttaactttaacgccttcaactactggagcgccgatcttgatatcttcaccattagcgaccatcagaacctggtcaaactcaacagtttcaccggttgcgatgtccagcttttccaagcgaattgtctgaccttcgcttactcggtgttgtttaccaccactttggaaaactgcgtacatataaactccgctttccgcgcaccccctaaaatatctttccagagcgcgctataaaatattcacaatagggcgcgaattctacgcaaaaaccgattcgaagacaagtgcagaattagaacagatgagaaaaaaacagagtttttcgattgtcatttatttgaacggtttttcaagtacaatcgatacatcgtgatatctgttgatatgctaatttaatgagcacagctctgaatcagagtccaaagccaaaacatgaatttagaatcaataattaaacttaccgctgatgatatggcagcggttaatgaaaccattcttaatcaattaaattctgatgttgcgctgatcaaccaacttggctactacattatcagcggcggtggtaagcgtattcgcccaatgattgcggtactggctgggaaagcacttcattgtgaagaagaaaaacatatcacagttgccgccttgatcgaatttattcacacggcaacgctattgcatgacgatgttgtcgatgaatccgacatgcgccgaggcaaggcgacagccaacgctatgtatggcaatgcggccagtgttctggttggtgatttcatctacactcgatcgtttcagatgatgactgatctcgattccatgcgggtactgaaattgatgtccgacgccacgaatgtcattgccgaaggtgaggtgatgcagttgatgaactgcaatgatcctgatacctcagaagatgattatatgcgtgtgatttacagtaaaaccgctcgcctgtttgaggtagcggcgcactctgcggccattttatccggcgcgacaccagagcaggaagctgcactgcgtgactatggccgttatcttggcacggcgtttcaattgattgatgacctgctggattacgattcagatgataacacgctcggtaaaaacaccggggacgacttaaacgaaggcaaacctacactgccccttctgcatgccatgcatcatggagcccctgagcagtctgcattgatacgcagtgccattgagcaaggcaatggccgccatttgttagataccgtactagcaacaatgaaacagtgtggttcacttaagtacacccgccaacgggcggaagaagaagcagataaagccatttcagcgttacaagtactggatgagtctccatataaggcggcccttgtgggattagcccatgtcgcggtacagcgactttcctgatctgagctaatcagtatcccagattgctcaatctgggatactgtctttattttcaacctcttgaattcctatgtattggactaggctagccagccctttcctcaaaatgaacttaaccatgcgttccctttcgggtttggtcaattgataataagcttcaatccaaatcatgaacggatcctgtcgcttattccgataatactcaaccgaattttcactgacggacagtacattcagaacttcttcgggcaagctgttgacatgatattcgagagctttcccctgcactccgcgcttacggcgttgttcccaaccctcgcgccttgccatcaagttgacgccttggggagacgatggcagacctgcgaggccaatgagttcctttgcagaataccaatcttttttcatctctttatcctcgctttacatcggagcagtgaagaggaagccaaattttgaacatttggcttttcaaaagctgcctcaagtcgctatgattttttccaaaaaacttcttatgccatctcgtaatatcacttctgtaatcgcctccttttcttcatcggcgagtaaattaaatgcactcacccaaatggatagaggatcttgtttctgaacctgatattcaggtgatatttcatgaagctccagagccgacaatgttgattcaggaaaacacgaatagtgatattcaatcgccctaccttgaacacctgctcgtttctgtctcaaccattcttcacgttttgctctggcattaactccttgtggtgatctaggtaactcacctacaccggtcaactccattgccgtataccactcttttttcataatgtttctctatttttgtaaccaagttcaaaaaagaagttattaagaaaaaattagaaatatttttagaaaaaataatgttattttattttcttaataacagattcgtgttcgttattaatttcacactaacgctttagttataccactaatgtggcttcaaatttaataggaaaggattaaaaaaatgatttctatgaaatcggattggcatcctgctgatattattgctgctttacgtaaacgcggaacgacactggctgccgtttcacgcgaagcagggttaagctcatcaactttggcgaatacactttctcgcccatggcctaagggagaatggataatagcgaattacttaggattacatccgtctgaaatatggcctagtcgttatttcgatccacatacaggagaactattagaaaggaaagttagagaaaaaaagaataattagctattaatataattattgaaagaaaaaccgctagttatttctgagctagcggtttcagttatctaatatatttaacttagttcgtatattaataaattacgaattaaatgaattaaccgttaataaatttctcgcctaattcgatatcttttttgagaacgtccaacatactatccagtgacttctgttcaaaatcgctaagtttgccgatatctaaacgttcttcgataccatttttacctaagcgaacaggctgagcgaagaatcgggcatatttgccatcaccttctacatagctgcactcgatgacattgctttcaccctgcaagccacggatcaaagaaagacccagacgtgccgctgcctgccccatagacagagtggcagatccgccacctgctttcgcttcaaccacttcagtacctgcgttctgaatacgtttggttaacgcttcaacttcttcatcagtgaagctgacgccctgaatttgtgacagcaatggtaggatagtcacaccagagtgcccaccaataacaggcacttccaactcctcagagttcttacctttcagttctgcaacaaaagtattggaacggatgatatccagcgtcgtaacaccgaacagacggtttctgtcgtaaacgccttcttttttcagaacctcagccgcgatcgccacagtagtattcacagggttcgtgataataccgattaatgcttttggacaagccttagctgcctgctggaccagattacgaatgatccccgcattaatattgaacagatctgaacgatccatgcctggtttacgcgccacacccgcagagattaatacaacatctgcgcctaccaatgcaggggttgcatcttcaccagcaaaaccagtgactttgacttccgttgggatatgactaagatcggctgccacacctggagtcaccggagcaatgtcatacaaggaaagttctgaacctgaaggaagttgggtcttgagtagaagggcaagtgcctgaccaataccaccggctgcaccgagaactgcaactttcatcctgatactccttaaataaagtgctgtaaaaaacttaaacctgtctggttaagagcctgaatctgtttccccacattcaatgcatgtatgggatagactctcagccccactgatcactacgtattaagaacaatctgttaacagacagattatctacctaatggcttgatgatgaaataccaaagttattttattctagacaaaaggcttatctgttaatgagataacggacacttttttgagaattaatcctgttatattattaataacttagttgattaccttactcttatctcccaaaccaaacaataccatttaattaacaatatatttaccatactcaatatgtgggaaaggaaacacagagaaaatgaacgcatgaatacactgatgattaataaggatatatcatggaaatgaaaataatgtaattatgcttattattttagttttttcttctcttccttgaataaaaattcactctttcgcataataatagcttcataacggattcaacgatggtgaaatatgcgtgctccttcgaaacaggaagatttggtcaaggctttcaaagccttattgaaagaagaaaaattcagctctcaaggtgaaattgtcgcagcacttcaggaagagggctttgaaaacattaaccaatctaaagtttctagaatgctgactaaatttggcgcagtccgaacccgtaatgcaaaaatggagatggtctactgcttacccgcagaattaggtgttcccacagccacaagcccattgaaaaatctggtcttggatgtcgattataatcattgtgttgtggttattcgcaccagcccgggcgctgcacagttgattgcacgcctgctggattccctgggtaaagcagaaggaatacttggcagtattgcgggagatgacactatttttacgacaccagcacaggactttacaacaaagcaactctacgaggctattctcgatctctttgatcaagaactttaaccctgtcgtatagccaaactacatatacccaatagatttcaagttgcagcacggtggcagacaaacggaaccctgagaatagagataaagaggatcgcacgactcatgcgatcctctcactctgatgattttgacaatcaagcctcgtgcactttcttacccagctcagtcagcaacttctcgtgaatgccatcgaatccaccattactcatgataagaatgtaatcacccggttgtgccacctcaacaatcatacgtaccaaagcatcaatatccgcactccagcgagcaggttggatgcagtgttccgcaatttctgcgacctgccacggaatattggcaggctgatacaagaagacttcatcagcacgtcccagagaaggcgcaatatcatttttgctcatgcccattttcatggtatttgaacgcggttctagcacagcaaggatacgagcgacaccgccaactttacttctcagcgctgccagtgtcgccaaaattgcagtgggatgatgagcaaaatcatcataaactgagataccattcacttcaccacgcaattcaagacggcggcgcgcattgataaaatcgcccagtacctgacaagcatccgcaggctgaacaccaacatgatgggcagccgcaattgcgatcaaaccattgtgcatgttgtgttcacccaccaatgaccagttcacttcgccaacctgttcactttgatggaacacttggtagatgctgctatcctgactgactttcttcgcttgccagttacccgtttccccgatatgttccagctcactccagcatcccattccgagcacatgtttcaggttaatgtcattatcgggtaccagaatcttaccactgcccggcacaaccctgacgagatggtggaactgtttttggacggccgctagattttcaaaaatatcagcatgatcaaattcaaggttattcatgattagtgtgcgggggccgtaatgcacgaattttgaacgtttatcaaaaaacgcgcagtcatactcatccgcttcaatcacgaaaaatggactttcaccgatttgtgctgaaacgtcaaaattgcccggcacaccgccgatcaggaatcccggcttataaccgcaggcttctaagatccatgctagcattcctgcggttgtcgttttaccatgcgttcccgcgacggctaacacccagcgttctggcaaaacatgatcatgtagccactgtgggccagatgtataaggaatgccacgatccagcaccgcttccacacagggattaccacgtgtcatggcattgccaatgattaccatgtctggctcaggatcgagctgtgaaggatcatatccttgaatcagctcaatgccctgtttttccagaagggtactcattggaggatacacattggcatcagagccggtaacttcatgacccagtgaacgagcgaggatcgccagccctcccatgaaagtaccgcagatgccaagaatatgaatacgcatttatttctatccaatatcatgaggtgtgtcactattctaaccatcaatgctgagattagaaatgcaatagcctatcaatcaccccattctttagctaaactgccgcgcatgagtgcgacacgcaagtgcagcacgctctctaaaaccacaacaaaattcagggctttcgtcatgaaaacattaggcgaattcatcgtcgagaaacagcacgactttcctcatgctacgggtgaactgaccgcactgctttctgccatcaaactgggtgccaaaatcattcatcgggacatcaataaggctggtctggtggatattttgggcaccagcggcgtatcgaatgttcagggcgaagttcagatgaagctggatttgtatgccaatgaaaaactgaaggctgcattgaaagcccgcggtgaagtagcaggtattgcttccgaagaagaagatgagatcgttgtctttgatggcgaccgtgcagaaaatgcgaagtatgttgttttgatggacccactggatggttcttcgaatattgatgtaaacgtttccgtcgggactattttctcaatttaccgtcgaattacacctattgggcagccggttaccgaagaagatttcctgcaaccggggaatcgtcaggttgcggcgggttatgtggtctatggctcgtccactatgttggtttacaccacgggttgcggagttcatacattcacttacgatccctcactcggcgtattttgcctgactcatgagaaagttcaattccctgccaaaggcaatatgtactccatcaacgaagggaactacatcaaattcccgatgggcgtgaagaagtacatcaaatattgccaagagcaagacgaagccacccagcgcccttacaccacccgctatattggctcgctggttgcagatttccaccgcaacctgctgaaaggcggtatctatatttatccaagcaccgcaagtcacccaacaggaaaattgcgtctgctgtatgaatgcaacccaattgcttttttggctgagcaggctggcggcaaggccagtgatggcaaaaaccgaattctagatatcacaccaacccaattgcatcagcgagttcctttcttcgtgggaacagaatcaatggtggaaaaagctgaaagctttatggctgaatttccaggtgagtaagtaggtttgttgattgaatagttaatttaatgaaggggcgaagtgtcgcctctttaataaacgacacgacttatcctttaatttgttgagcaacacgcttaacgcaacgacttactctcaacgttaacatcattttttccctgccgattatctatattgttcccttaagttctatacatactctttctctatttatatttgttcacgaaatcattctgttcatgactcatgaacaaggcagaagtgtgaacaataaaaaagtaaataatcactttttatccactacaacagattttataacacccaattcctgagctgtatggcgttcaacgactggaaaaatgcggggactttaagtctgttttggctataatagcccgcactccattttggtttgaaattaaaggaaaccttttatgagcctgaacaatgtaccggccggtaaagaactgcctgaagatatctatgtcatcattgagatccctgcaaacgcagatccgatcaaatatgaagtagataaagactccggcgcactgtttgtagaccgtttcatgtctacggcaatgttctatccttgcaactacggttacatcaacaatactctgtcccttgatggcgaccctgttgacgtgctggttcctacgccatacccattacaaccaggttccgttattcgctgccgtccagttggcgttctgaaaatgtccgacgaatccggtgaagatgcgaaattggtcgctgttcctcacaccaaactgagcaaagaatacgatcacatcaaagatgtgaacgatctgccagaactgctgcgtgcccaaatcacccatttctttgaacattataaagatctggaaaaaggcaaatgggtgaaagttgacggttgggacaatgttgaagccgctaaagctgaaattctgtcttctttcgaacgcgctgctaaaaaataatcctaaaggataacagcgggttttgatcataaaaaacctctgccaccacatagaggcagaggtttttatttattcttcttcgtggcgcttgatccagtcaccacatgttatccgatgcagtccatcgacaggcagtctatataaatagatccatgcactgccgtaaggtgttttaatcagttccctttcgtattcctgagaattctttttcaaagcatccagttctgtcaggatggatggcgtaatgcgatatacttcgcattcaattgtcccttcgccacggatcaccgctggataatgtcccaggtcataaatttcataaccttctaacctatgttctcctagaagttgggcataggtcatccagtgatggttaccttgtttgcgcctcaggctgccataaacaatcactcgcatttttaaaactcaaactcatagagcagatctaaagcctgatcaataccagataccgcatcgagatacaatcttggcattacacgatagcgtaatgtcaaggtcgccagagaatcaaaaataccaacaccgtatttcacctgcaagttgttggttatcttgccactgacgacaacctgagatttgtcacccacaccctgagtatctaaagctaaatcagaaacaccaaaagtttcaccaatcttgccaaccaattgaccactttgggaaacgcccaaaccaatcagcatggaagtcatttggttattgtcagaaccactcttctccaaaccttcaccacgcagaagataagacagtgcttcctgctgtgattttgctggctcagagaaaatttcaactttgggtttatccgccaatcccgtaactttcacaccagcgacaaccttattcgccgtcgagtcggggttacggattgcttcaatgttcaacatcggctgttccggcgggccagaaaatatgattgtacccttgcgtaccagcaaatcctgcccgtaggcatggaaacgaccatctggaatatcaatctggccattcagccccagcccctgtttatcctgaatgactttcaaggctcccttaagttgagctttcagaccaaatgcattcaaacggacatcatcaccaatgcgaatatttaagttacttttaaccagaatggacgattttttcttctctatcggctggagatttttatccagcatgacttcgtcagaagaaatacccacagcagactctggtaattcctgcaccgtaatgcgtgcccatggaatatccacattcccatcaagtttcagtagatcaggcgtggcttcaagtaccagattagggctaacatcaattttcaccattggcggcactgtcacacgcaatttttcaccattcgcggcaatcttggcataccatgcgttcaaattacgccagtcagcattgccgttaaggtttagctgccctttaggcgttttgataacgccctccaagccagagcggacaccatcaaaatagatagctagctggccttgggtgatatcaaaaggcagccaatgactgacgatttggagatcatccgtcttaagctgaccaaacaacagcgggttttttacattaccaccgagacggaggttagcgttcaaatccccttctgctttctcgtctttacccaaaatcggtttaatcagctttaaagaaagagcttgaatatccacattcccagacagcttgcggcggccttccaggtcagccacctgaacattgccattcaattgcccattgcctgccagcttaaacaaccatgccacatttgccttaccatttgttagtcctgcattcactgttaatgtttcaaaatcaacaggtaatgcagtcccctcaaccatttggtgaagctgaaccccatttccttgcaagacgactttagcctgtggcaaaacctgtcccgcagtccatttgacattggcattcccgctgaacacgcctttaagttgggtcattttatcaaggaatggctgaatcatggccaaatcaaaacgcttaagcaccacttcagcatgaccactggctcccgcctcaatcggtttggggacacagatctgtgcattcgggttaagccagcaatgtgttcctactgtcactttctgctgtagattcaggtaatcaatggcaatcgccttacttaagcgccactcaccaacaggagtatcaaagtaggtattgttgatagtcccttgccaacgctcctgcccgcggtcaaagcggccattgagtgccaattgacctgatacggggttaccctcaattttcaaatgtaaatcatgctgcttttccgtgcccttggcatttagcatcaagttattgatgattaaatccgcctgtttcaattgatgaacagtaactaagagctgtccttcaatctgttcagccgagcgcacatctcccttaatcgtggcgctatccactttcagctcattctgccaccgcacattacgtgcatttaaatctgccactatttgtggcgctttcatgttaccgcgcagtttcacattaccgataaccacaccagccaatcccggcagtagtccatttaactgtggtgcattaatttcaccgtccaacttccacttttcatctgtaagctgcccttgaacattcagcctattgcggccaaaagtgaggtcaaactgcggaatattccactgtcccgccgcattacctgacgccttgccatgcgccttgacggtattttgtttcacatcaccgtcaagagcaatttcagggatctggagttgccaactaccaccatacaggctaccgcgcacagccattttgccattcattttagctggccattctggccactgtttagctgtattgatgccatccagaatcaggttcgcattccagctaatcgctttactccagtcaacaacgccagtgatctccgccttcccctgcaaggcagacagacgcagacgggttagcctgagcagttcttcattacccttcgcatccagcatcagtaatgcaggaggaatatcacgacctttaatatctgaacggagggagagatcgtagccactggctttgccattcagtcgaagcttaacgccatcaagtcgatattccggttcacccgtcaatggccactgaagttgtttgctttccaatgtcaggcgtacaggcaaacccgccttcgccaactcagtctgagcactcagattggcaacaacaggccctgaaagatgcaatgccagattaagctgctgcaacagagcaccattcagggttaaatcaaccttttgcccttttagttcattcagatttgtattgcccttaatcgccagtttgactggccactgtccaaatagccccaccgtcccctgtagcgaaagtgagccttccggtgcacttacactgaaggttttcatatcaacctgctgcccctgattactggcttgcagccgtagatcattaatcgtgatacctgtatcacctgtcaggcgaagctgactgccatgaatgttttctgccgtaatatcgagaggaataggaacattgggcaattcagctaagaaaggtttggcaaatagcgccttcaaggtttcacccaatgatttttcaggttcaggcttttgtttacccttttgcgctgtattttccactgtaccgctttgttcaggcggcgttttaggcaaagcaaccaacagattgctgatttccgttggtttcaatgtcagctgtttttccctccactgcgctcctgttttaaattcatccaacgcaatcactatatcgtcaaccttgacgtgggtattcttcaaagaaagcaaatccagtgaaataggatacggtgttttcaattcagtcaatggttctgatgcaggtgactcttctgatggaggaagctcagccgtattcaccgaaactgccgcaccttctgtagtcaacgcattgacacacaaatgactgtgtttcaggcaggataagcgtaacgaaaggtgtaaattgtcagcactgacatttactcccggcatctgatatttaacaccttttaaggttaaatcgcgccagcccccgctgacattggcgatatccagtccgggaacccaacgtgctgcgctgttaatcataaaatgcaggccagtttgtgtgccaaccaatcccataacggttatcagcaacaggccaacaagcagcagaaaagcaatactgaaccttttgatccacctcatagttcagcccctaaaccgatgtaaaactcaataccatgattgcttgcgtctcctactggcgctgcaagatcaaatttaattggcccgacaggtgaagcccaacgcacaccaacccctgcgccggttttaaaatcactttttttaatatcatccaccgcttcacccgcatctacaaacaacgcactccaccaattcccatagatattgtattgatactccagtgagccaacggctagtttcgatgccccagtcagcttcccctcactattttttggtgaaattttttggtatttataaccacggatgctgcgatcccccccggcgaagaaacgtaaatccggtggaaccttgctgaattcattggtttcaatccagcccagatccccccgtaccacaaagcggtgcttatccttataagtcctgatccagacgtgatgagcctgtaacaccaagaaatccacattcgaatcccaggttttatcggaaaaatctatcgaataacgctggctatctccccaataaggcatggtgccaccacgctggcgaattcggctgacattcgctcccggatagagcagcatcgtcgtatttgtcacattggcctgcgtaaagtgactaagactccagcgtaaattgataccatattgccatccggtggagagatcccaattgcgggaaaggttcaatgttgcagtatcagaaatggtatcgttaatatctttacgtttataacctgtctgcaactcgtaatattgttcaagcggattagatttgagtggcattttgtaggatgcatcaataacttgttcaggtgccgacagattaatattggtactcaggctatgcccacgcgagttaagccatggctttttccattttgctttaacgcgggggccgacatccgttgcataacccccccctagttcaacataattggcagagctgggaaccaaggaggcatccagtggcaataacttatcctggctcgtgtggcctaccttaaaatcaggcacgacaaccacagaattgaaccatcccgtattcgccagacgactgctgaactccgcaagttgatccgaggtgtaatactcaccttgtttaaagggcaaaagattgttcaggtaattttcacgaatttgcgagccgtggtatctcacggagccaaagcggtaacgatctccgctgtcgaaatcgaagttccaataggatttatgctgttcccgtgatacttctaattcactttttttcatcgcagcatcaaagtaaccttttctaactgccagactattcaatgcgcccttgaaatgttcgtattcaccatgattaaggatcaccccttcctttggcatattttttttgatgagtgacgcataatctttatcggtttttgcgctaccttccaaatcaacattgacttcgactacccgtaccggttcacccggtgtcacgttcgctgtcaaaacagggcgggaagggggtgttttctcctgataagtgaattcaacagtgggatcgtagtatcccaatggccttaacccttgctgtatggctttctcgacacgggcctggaagcgcccatcgggagcgacttcatcggtacttatgtttgagagctgtactctggcatttttttccagttcgccagaaagtccttccactttcaatcgtaaatttgcactataggccgatggagttgcgacagacacgcaaagcacaaatatgaaggggtatcgtgacacgcaaactcctaatatttatctatctggggataaaatccaacgatataaaaatgctgcaataaattaattctggtaaagtttgaaagatatacaagcaactaataaccataaaatttatgaataacgggagagaatcttgccaaattcagccaacgaaagccaacatgtttccacacaggatgcattactgggtagggcaatcccattaactgtatcaccctaccacgtcgtcacacagcattcgataaacgacattcctgaaaacatggagatagcttatataggaatggggtgtttctggggagttgaacgcctgttctggcaacaggaaggtatttacacgacctctgtgggttacagtggcggtactacgccaaatccaacttatgaagaagtctgcacagggttaaccggacatgccgaagtgatcaggatcgtatttgatccaaccaaaatcacttatgggcagttattgacgcttttctgggaaaatcacgatcccgcccaaggtatgcgtcagcatggtgatgtcggtacacaatatcgctctgccatttacactatttcatctcagcagtacgagcaggcactcgctacccgcgaacaattccagcaagcgatggatgaaaatggcgaccagcgcacaatcaccacggagatccgcgcagcggagccattctattttgcggaagattatcaccagcagtatctcttcaaaaatcctgaagggtattgtggactcggtggtattggagtatgcctccttcctacgcacaaaaactagccgatttagttagctcagtgttataatcattgggctaaatttatatatcttacggtaaaatgccgtaagattttatttgtataatttttcatctcccctccggtgttattcaaataaaacctaccctaccgctggagataaaacacgggtaccttatgttaaatagtttattaataatatttttgctatgtgcaatcagcgcatttttttcgctatctgaaatttctctggccgcctcaagaaggatcaaattaaaactcatggccgatgaagggaacctcaatgctgcccatgtgcttaagttacaagaaacgccaggcatgttctttactattgttcaaattggtttgaatgcagtagcgatcctcgcgggcgtcgtgggagaatccgcattttcacccgccctgaaaacactattctcaaactttatgcgtcaggaatgggccgatcaacttggctttatctgttctttcattatcgtcaccagcctctttattctgcttgctgatttgatccctaaacgcattggcatgattaagcccgaagccgttgcagtgagaattgtcaatccaatgcgtttctgtctggcaacttttcgcccgttggtatggctgttcaatggccttgctgactgtttcttaaaaatctttaaaatccctatggcacgtaatgaagacatcacttccgatgatatttatgccgttgttgcagccggagcgttagcgggtgtattacgtaaacaggagcatgagctgattgaaaatgttttcgaactggaatcccgtaccgtgccttctgccatgacttcccgtgaaagcgtcatttattttgacaagaatgaagacgaaaacagtatcaaggaaaagatctccacccatccgcattcaaaatttctcgtttgtgatggcggtattgaccatgttactggctatgtggattccaaagacttactcaaccgtgttctaaacgggcagagcctcagcttgaaagatggcgttcaaacccgcaatgccctgatgatccctgatacgctctcactctctgatacgctggaaagtttcaaagcggctggtgaagattttgcgatcatcctcaacgagtacgcattggtgatgggagtcattaccttgaatgacgtaatgaccaccttaatgggcgatttagttgatcaggggcaggaagagcagattgttgtccgtgatgaaaattcatggcttgttgaaggtggcacaccgatcgaagatgtgttgcgagtactggatatcgatgatttccctgactccagcaattatgaaaccatcgcaggatttatgatgtttcgcctgcggaaaattccaaagcgtacagattttgtgaaattcagcggctacaagtttgaagtggtggatatcgataattacaaaatcgaccaattgctggtgacgaaaattgtggacacaccaacccaatccaacccatctcccagcggtcaagcacaaacccagtaaaaaatccgatcaaaaacggccgcgaggccgttaattatactcatcatacgctatgtgctatcaactctgacacataccgttcggtgagtcagtcgttacagaaaaactaccctatttcagcctgtaggcgcaacacttgctgattaatttcgctcattacatgcaagtgacgtttatcttttatcttgggtggtaagatcttcccgtagttaaattcaaaagcgcccatgtccttaatatacaaacgcccacgaaatagagtttttacgtaaagagcaactttcagtgggttataatggtgaaagattttcatttatttttttctcctcccattctgcttacggtactatttctactgcattacaccatcagtgaatcaaaagacacatcactgctgtgtaagatgtatagactatgcatatagaaatttgttccctgattttagagattcaatcactaattttacgtaacataatgaaactatagagtattatgttgctttaacatgggattaccttatattttgtttcaaatgttatcaatttgtttatttttatgaggacagaccagttaacaagcgctatgctgaatgtgacgttccctgataacatgcttcaccatgctaactaaggaataaatatgataaaaaacattgtgttatctgcaatgctgagtttaacttcagtattcgcattcgcccataacatcacagtaggacagccagtccctgcggtcagcgtgacagataaaggtgagttactgctcaacaatgacaagttcagctaccaaaattggaacagtacagaacttcctggaaaagtaagaaccatccagcatattgctggccgcagttctgcaaaagagatgaatgatcctctgattcaagcgttgaaacaagccgaccttccaaaggcaaaatatcaaacaaccagcatcgtgaatactgatgatgctatttttggtaccagcgtcttcgttcgtaatagcctcgaagacagtaaaaaagagtttccgtggtcacagtttattgtcgatagcgaaggtttagccaagaaagcctggggtctggaacccaaaagttcggcaatcatcgtgttggataaaaacggtaacgtgaaatttgttaaagatggtaaattgagcaacgaagatatcacccatgttctcaatctaatcaaagaagaattgaacaactaacctgtagtttcattaacacttcagtaatcataagttagtcataatggttccaaaacaggaaccattatcaccttaataattaagaaactaataactaaaaaatagtgactctgaatcccggattcagaaaagattcacgcggcgcgtaatttaacttcttaccttcccaatccgtgacatgtgcacctgcggcaatcgcaacagcgtggcctgcggcggtatcccaaatattagttggcccaaaacgcgggtaaagttgagcttttccttctgcaaccatacaaaatttaagtgaagatccgaccgaaagtgtctgatgagttcctaattgagtaagataatccttcaattcctcgtccatgtgagaacggctgatcaccacagtcggcagcattgcagcagcaaccttaataggaattgtctgcccattggtttccttccaagcctgatgtccctgccctgcgtacaaaacattcagcacaggaacataaacgacgcccatcaccgggacaccatcctcaatcagtgcaatattgacggtaaattcgccgtttctctggataaactctttcgtaccatccaacggatcaaccaaccaataacgctgccagtttttgcgctcctcccatacaggaggatcttcttctgacagcaacgggatatccggtgcaatacgcatcaatcccgctttaataatcttgtgggcggcaatatccgcagcagtaacaggtgagtcatccattttatgctctactttcaacggctgctcatcctgataaaccgccatgattgcagctccagcttcccgcgccaattggcagatctgttgtagcat

SEQ ID NO: 16898 - DNA, 27318 bp, Xenorhabdus bovienii
  unsure (1)..(27318): unsure at all n locations
aggtatgccagaaaaatatattaattaatctattcaaaaagttcgttgctgatagctttggaacagattgttagataggaggaatcctattttttatagggtaatataaaatataaaaaaacctccctgtaatagggaggataagagcgaaatgagaagcaaatgagggtgtacaaaaaataagatatttaagtacacacaaataaaatagacttaaatggcggaatattcaataaacagacattaaacaaatcttaaagccaagagcgtatcagggcgggattccactttaagatcgattcttttatagccaaaaaacgtatctctacgtaaaattttcaccattttatccaagaaatcacatcatattttacgtacaagctcctaaagattaatttttaagcaaagtaaaatcccgccctgaagagcgtatcccagtagatatttattgttgatgtcagtttgaacaacgctcaggttcaaaatggcaaataaaatagcttaatgggataggttctgagtatgctctcgtattggtgggggttctatcgcattaacaaagaaagtacgagttgatgcggttacaggcattctgtcttgtaaccgcttatttttgcccggaaccagcgcctaagtggcatgaaacagtacgttggggctaggagcctctgcaatggtcactcggccatttccgcaatctgcttgttatgactattttgctgacttattttttgctcaatatgccgtaccacataggcagcatcctgatcgatccccagaaaccgcccagagccccatgtatgtaaccacggcaaaccaataaacgtgacatccggatcaatggtaataccccgatcatgttttggataaccattggcttgaaaaatatctaaatcaatccatgaataatccggcctaaaacctatacaccaaatcacggaagtaatatttgcttttgctaaattaatgtgtatgatttcctgttctggctgccaaacaggctgatataccgatacaggctcatcagtctcaatgttgtttttagctaaatattcatcaatagaggcattaatccgattataagtagcatcggcactatccagattttctgataaatctggcctgaaccagagttgaccctctttatagtcatcaaaacggccaagcaactgcataccttctaaagcaaatttacgcagatcaatatcatgtccgccatcacggcctgtaacatagtggttggtactgttacgtacttcttcactatagcgatgatctttcgcagtagttttgtaatggcccatatcaaacagccaattcaccacatctttgccgcgatagaaccgggcacaacgtggggcatcacctgtcgataaatagacttttttgcctgccagatgtaagtcttcggcaatttgtgctccagactgtcctgacccgaccaccaacaccgcaccttcaggcagttgatctgcattcaaatattcttccgaatgcattacttttatattctcaggcaaaacatcgcttaattttggataaatcggggtgtgatacccgcctgctgcgactacaagctgtttggctgtggttgtgccgtaattagttttaatgacaaacttatatgctgcctctttttccacatgttctacctgaatgtttaaaatggcaggtggattgagtttttcaataaactcatcaagatattccacgatttcgtgctttttcataaatccgtcgggatcttgcctttgataaggatgttcaggcaacaggcactgccagttcggtgtcaccaaggtaaaattatcccaacgtttacggcgccagctatgggtcaactcagattctttttccaacaccacatgatcaatacctgctttttgcaaatagtgactgatgcataaacctgcctgaccaccaccaacaatcaccacatcataatttggctgtaatatttgattttggatatttaacatagaacatccctctcatttatgcgtcatttcaataactgtaatttgatcttccggactgagttcgaacagtttggcttggtgttgaatcattgccagattgtccatagctgaactacagccaaagccataacatgcccgtactctttctgatgcggcatacagaccatcttcaacctgatgcaaaaactgcgtactcgggtaacactggccaatggacaaatattcataaatcacggttgagggtgagtaatattgagtttgttctccattggaccacttcacagtaaaattcacactgggcataacataggctcctactggctttcaggctcaatctataacgggttgaacctataatttttttaaactgatttttttaatcaaatgctttcaattaaatgttttcaagacattggcataacaaaaaccggtaaatacttggttattaaaatcccaaaatatgccgtgttgctgttgttgctgcactgtgaccacaccactgacattggtttcagcaatcactgtgcaggcaatgtcctgactgtgaaacagcttgataatttcttcacatttatcgacattggcagtcagtaaaaaaccaaagctgggaaaaatttgcagccatttagaccagtccacatcatcaggtttaggcatggcatctaggttgatatgagcccccgaggctgtagcttcgagcaacatcaacaaactgcctaaaatgccggcattgctgatatcacgggctgcatgaaccaaagctgcttcagccaattgcggcaacaaggcaatttgtgactgtaaaacgcagtcagatacctgctcaaagcatttccaataagtggtattggggtggaattgcccttgcagatttaaagccatcaggattttttgttgtggtttgacatgcagcactgaaagcaattttcgcgccgtgccttgaatcgcaaccgataaagcgggctgataaactgtaccaagattggtatgtccaccgactaatggcacaccataagcatgacaagcatcctgcatgccttgcattaacaactgtgcctgtttgctgttggtatgccaaagactgttcaccactgacaacgcccgaccgcccatggctgcaatatcactaatattcgccatgactgccgcccatcctgcaaaataaggatgattggccacaaaatttggcaacataccttcacaggcgtgcaatacatactgaccattcaatggcagtgctgccgcatcatccccagggtaagcatataagctatccaatgaatcaacatggcaggttgtattggctgaaactgtattggttgaaatactggatgcaatcgcctgcttggactgcatggcgggtgtgtgtctcaatatttcgagtaattgattgagttccatcattgcgtctccttctgcatataggtttgcatcgggatatactgcaatggatagttttcaatctgtgcctgcattaacacatgtggaatgttggcaacggtcaactgacacaaactatcccaacacaatctttggaagtagtgttcattttgactttgcacggtggctaaaaaagtacagcatcccaagttcttggcggtcgataccgctgcattgattaacgctttaccaatggtatggtgacgtcggtatagaggctctacacataaacgcccgccataccacgtctgttcgccatcggggaaaatccgtactgcgccaatcacacggtcatgctcacccgccattttcccaatggcaacaatacctaatgctttaacatcgtactcgtcacgatcttcttttaagattttctgttcatcgcgaaaggtcacttcacgcaaacgataatattggcggcgttcccaatcttccgacaccattttgatggcaatgtcatcgctaataaattgtttcagctcttcatttagcccaaacagacaagcataacgagaaagttccatatcatattctccttattcatatgctttcagcgaagaacaagcgccgcatttggcacaacctgcctgagtattttctgagttcaagctatgttgtttgagttgcaatccgattttcgggtaaagcgactgcataaaggcgtgatcaggtttaggatgatgttctaatggtgtgccttgaattggcacaaacggcaccacaaatggatacacccctatttcagtcagtttggcagtcatttccacgatttccggttcggtgtcgcccaatccagccaaaatgtaagtactgacttgtcctcggccgaacacggcaacggctgcctcaaatgctgaaaaatacttttccagcgatacttcagctttgcccggcataatcttttgccgtacacgctcactcaccgcctcaaggtgcattccaattgatacagcgcctgcatcttttaaacgttgaaaccatgcaaaatcatcgggtggctcgcactgtacctgtattggtaaatctacttgtgccttaatcgccttgaccgagtcacataagatttttgctccgcgatctcccgtatttggcgtacctgtggtgatcaccatttgcttgataccatccagctcaacggctgctttcgctacctctgccaattgttccgggcgtttacggatcaaggttcgatcccctatcaaagactgatcaattgagcaaaactggcacgccgttgccttgtcattcatacgaatgcaatgctgtaacactgtcgttgccaacacatcatggctatgtaaggtcgcaatttgctcataggcaataccttcggcggtttttaaatcataaaatcgcggtcgtgcaggtatagttaagattgccaccgggatccggtttttaaagacagtcaccttgtcagagttcagatcaggctttgcagtatagggagagtcttgtgctgcaaggttcagcacaggaatcatcatggtttttccgtcaaggctcagtgccttatgatcgcttggccctgcgccacctttgcgggataaaccaaactcgccttcccatttcagaccattacattgcaaatcggtcagtaattgtattgcagacatatttaccccctattacttgggtttaatcaatatggttcagatctgggtttcattaaatttcgcgtgtttttcgagatgattttgatctggtgtttcaattttcagttcgtgcaatacatttgtcggacggcgatcaatcaataagctaaacaattcagggcgactgtaatgtcccactgaatccatcatgcgtttgcgtttattaatcaggctaagatccagatcggcaatgcagtaaccttcatcttgcgtgagcggttcagctaagaactttccttcgggagaaacaatggcggtaaaacatccccctgaaattggaccgatgttacagcctgtatcctgcataatctgctgctgctgttcgggatgcagccatgcggtggcattgaccacaaaacagccggattctaacgcatggtgttgaatggttgcactgatttgatcggcaaaaatttgtcctaccaacgaaccaggaaacatggacgcatgaatttgctcaccatctgccatcaaggcaaaacgtgccaacgggttgtagtgttcccagcatgccagcgaaccaacacgccccaccgcagagtcaatggcatgcaggccactgccatcaccttggccccaaaccattcgctcatggtaagttggcgtaattttgcggcgatgctgaatgattgaaccatcggcatcaaataacagctgtgcgttatagatcgtaccgcccgcacgttcattaataccaatcgataccaccatgttggcttcaaggcaggcttgaccaatcgccagagttgcttcggaaggtacaaccaccgattcattcaacaactttaaatgctcttttcccatggcaaatggcggttgtacaaaggaaaaataagggtaataaggcacgacggtttcaggaaaaacggcaaattgcacaccttgttttccaagctctgaaataatgtcacagattttttttaccgttgcggcttggctataaagcacagggctacattgcactgcggcagctttaatgattcggttcatgtcttattccccttatgagtttgcgcttacttaaacagtccaagtatcaataattaaggcattttcacgacgcatcagcagttttaaatccatcacatccaatggattaatcgggcgaattcccggaataagtgctttctctgtttgaccatacattgcttgcaacgcaaaacgacaggcatagacttcgccgccttcttccataaaggctttcaattggttattgacggccaaatgacccggaaaagcctcagcccctaaagttggaaaaccacgttgaacacccaattgcacacccgggccgtaaagcaagattttggtttcaaagcccttacgcaataaacgctttgcctgtaacacattgatcaggccaattgatccttcaaatgcaacggtatggaaagtcaacagtgccttttcacccggctgtgctttgacgtcctcaaacactttttcttcgtaatcaacaagaaaatcgccatctttatattgttcgatatcaatttttggcataacagctcctagttcaatgttattttggaattaatcaatatgtcgtcttcctgtgttatagcgaaagctatgccaagttatatttctgggcaggggatttgtgtttatctcattgaaaaatataattaaaatttatataaaatatttttattaatataaatgggaccgctgggatgttatgattttccgtagtattatgaatttttatagtttcaattatgaaacttcataatatgaatatgaggaataatatgaatacaactgattttatttcggattgggtaacttctgaaaactcgattcgcccgttggtatttgaacacacatcacaggcattaattgtgttagatccacatcaaaaccagtttattgatgtgaatatcagtgccactcgattattgcgttatgaacgtcatgaaattattcaaaaaacaataacttccgtttttggtcatttaagccaactgccacacctgctggcatttaccgaagaagctttggaaaaagattgggcttggaacaatgagctatgttcctttgataaacatggtgaaaaaatccagttagatatcacttctatttcattgccctataaaaacaaaacattgttgatatggtcgctggtggatgtcagagagttagaactgcgccaacttaagaaaaataccgataaagccatccgtacagatttaaaagaatggcaagccttacaagaattgtttatcgactccgacacaggcaagcatttattactgagttcagtcggggacggtatttacagtatcaacaagcaaggcttgtgcacctttatcaatcctgccggggctaaaatgctggggctgcaacctgaggatgtgctgagtaataatattcataaaatccatcaccatacccatgacaatggcgatcattatcctgttgaggagtgcccgatttacgcggcagtacatgatggtattgtgtatgaaggtattcaggaaaatttttggcggcgtgacggcagttactttccagtggaatttaccagtaccccagtgatccgtgacagtgaaattatcggtgcagtggtggtatttcgcgatattaccgatcggctgaataccgaaaaacaactgacccatgcccttgaagaactgcaagatttaaaaagccgactggaacagcaaaacgaatatttgcaggaagaaattttacaagaaaataaataccatgaaattgtcggcaatagtgcatctattttacagattatcgaaaaaatcaaggtagtcgcctcaacggatgccaacgtgatgatttatggtgaatccggtacaggcaaggaactgattgcccgcgcaattcaccaattcagtcaccgtaaacaacaaccacttattcgggtcaattgtgccgcgattccttcggaactgtttgaaagtgaatttttcgggcatgtcaaaggtgcatttactggggctgtgcgtgaccgtatcggtcgttttgaattggcagaccaaggcacattatttttagatgaaattggcgatattcaaccagagttacaaagtaagctactgcgtgtattgcaagaaggcacctttgagcgggtcggcgaagaaaaaacgcggcatgtgaatgtgcggattattgccgccaccaaccgtaatttaaaagaagatgtgaaatataaacgctttcgtgaagacctgtatttccgtttaaatgtatttccgattcattcccctgccttgcgtgaccgtagggaagatattccgcttttggttacacattttaccagactgatttgtgacaatcgtaaaattaagtatctgccattttcacaaaagcatattttggagcttcagcaatatgactggcccggtaatatccgtgagttgcaaaatgtcatcgaacgggcgctaattacggcaaggcaaggcgctgtttcctttaaatatttgttggaacaagatcaacagcaacctaagattcagcgtcaggatatttacaatgaatatcaacaaaccgaaggcgttctgactatagaacaattcaaggagttggaaattaaaaatctttcccttgcggttaaacaatgcaaagggaaaatttttggtgataacggcgcagcgagattgttgggaataaacccaacaaccttgatctcacgcttaaagaaattagggattgattattaaaaatctcatccagaggcaggctattagatgaatctgtttccatttctttctgcactttggataacgtagcataaaaactcaattgtcctttgcgcaacatacagacccataacaatgtccatgttttgcgcgatcggggtttatcactaaggacgctggatggtgggcggctctatgggataactataaagtagagggagtggcatggatgatttactgtttccgttagccgggattacctgtgtatatgtacagtaactgacggtggtgtaaaaaaataaaattaaagcttgctaagtaaataaaaatagtgcttaatagcgccatcggtttggaagtacagacctatttatgtaaagcaagtttaaagtagttcaccttttagcgctatcttcgataccacttcattgcgaatttcttctacttagtgcccataagtaaaacagaaaacaaaccttacaacgccttatggcaacttaaaaaattaaaggaattcaacatgtctaatacaatgactggtacagttaaatggttcaacagcgataaaggttttggctttatctctccaaaagatggaagcaaagatgtttttgttcatttttctgcaattcagagcaatgattataaaactttagatgaaggccaggaagtttctttctcagtagaaagtggcgctaaaggcccatcagcaactaacgtgattgctttatcttaatcactgctgaacagaataagacgatgaccttatgatagcgatgaaggtgtaggccggagcacataaggttatcatagaagcctcgcagaaatgcgaggctttttcgtatctatcagtagtagactgagaatttgcaactcgaccccggcaaaatttactgtagttcgatatactaaaagactcagaaaatattctaggctccgctccggcgtggccttttttattttagggtactaactgtttcttcaagtaaaactctataggataacacctgctgaaagttacacatcgcgtggttttttatgcctgtgtattcaatctgaattaacaaacggttaagacggaacaatgtctgtctgtatgtgaagcctgcccaggggggcgtcgaatataataaaaatggcgatcactttgtttataaatacccagcccctataatttattggctgattactgctgtcagggtaacttagctatcttggcttctacgacaacaccaacaatatgcactttctcattgagaggtatcatattgtattgaggattcagaggctttaaataggcatcgtatccttcggtaattaattgcttaaaagtcagctctttttctccctcaagttttgctatcaccaagttattagccgtaggcttaacatcagggtcaatcaaaatgatcataccttgctgtatgtttaattcattcgatgatgccattgaattacctttaacttccagccagaaagcatgaggtgaacattcaatagaagtttcataccattgttcaatatcgtttccaggatatagcggtgcaggttcttcacaccaactacctgcatttgcccagttcagcaatggatattgtttttgaggatgttgatgagcggcaagagtaggatcatcaccatagatcaccttcaggagtttcctggcctgttgatctaatgatggactgaaatctgcaatgcgaacgcccaatttattagcgaagtcggccgctctctccaaattaagggcgtttataccattgagatagtgtgaaacggcgctttgagtcatgccaagctcgtctgcgaatgcatcttgagaagagataccgagctgcttttgccttgacacaaatatgcgcttcaaacgtttggcatctgcaagttgttctgttgttagtttctttttcataagcctattttaataccaacgctattaaaatgataaatactaaaagtattgaaaaatttaatactttggatattatttcgaagtagacaggagaaaacgtatggaaaagatcttattatcagaatatgtgaagaaaaatggccaagtgaaagcagcaagtctggtcggtgttcatcaaaccgccataagtaaagcgttgcgagcaggtcgtaaaatatttttgatccgccaggaagatggcagttacaaagctgaagaatgtcggccatttcccagtcagaaacaggctgtatagaagaattaaaaaatatcaggagtatgattaatcggtatctattattgaacggacttaattatctcattgattttattctgatgttttttgtgtatattgttcaggagaagatatgggttctaacatttgtcattattttagagcgatagggagtattcttgacattatgcccgcaaacgattatcgcgagatcttggattctgatttatcagatagaaattcctcggaaagtcaggtgatttctcgttgttctgaaccgcttccatcccctgatgtgttgaagaactacgagtcaatcctgtctggttgtgcagaaagaatattgtctttcagagaaaaagagcagcgtttccggcatgataatcagaaaaaggcacttgatagcatgatcacaaaggataaaagggggcagtggatgggattttccattgcgatgtttatcttaaccatagcgactgtctttgcgttcaagggcgaaatgttgtttgcaggaacgctaattaccattgatctggttgggctggcagccgtgtttgccatagggcgtaaatcaaacatcaaatgactccgaaataataacgtaacttattgatattatatgtaactatgttcatttgccacttttatatcctctcaattttatttgaatatcttcttgttgtttttatttcataccatagaattgacatggtttacatcgacaagaataaaaagaattttgcatggtaggtttaactatctattttaaatgaattagcatgttatgagaatttatatggacatgagaactttatgtgaacgttatcaatcaggaaaaaagattaaatatctttttttctgggggcataaaaataatcatactgattacataacaaaatcctgcctaagccagtggtatccagcaccatttatcgttaataacgtaagttattccagtactgaacattatatgatggcagaaaaggcgcgtttatttaatgattctgcaacactggaaaaaattatcaatgctaaaaacccaggtgcagcgaaagcgtatgggcgcgaggttcgtgggtttaaccaatcgatttgggatgaacatcgattggcgatcgtgattgacggtaatctggcaaaattttctcaagataatgctttggcagagtttttattgaatacgggagataaaatactggtcgaagcgagtcctgttgatcgtatttggggtatcgggctggcagaagattttgccaatattgagaatccgttgacgtggaatggtttgaatttattaggatttgccttgatggctgtacgtgaagaattaaaaatataagacatagattaaattttagcgcctaaaaatctaggcgctaaaatagaatgggaagggatagacaattttattcccatttagtgggaatgttactcactaggataatgtcaatgacacaacgaacgataagtagtagcgacctattttctggcaaaaagattattattgtgcatggatatagtgcctcaccttcatcacattggttcccttggttaaaagaagtgcttactgagcaaggtgcggaggttatggtgcctgcaatgcctgagtcattggcaccgatacctgaaatgtgggccaagatgttgattgatgtaataccaaaggcagatgatgatacaatttttattggtcatagcctcggttgtgtcacgttattgcggcatttagaggcgataagttctacggctgaccgaattggagggtatattttagtttctgggtttgattctccgctggagaatttgccaaaattaaacatttttacagccgaaccattgagctatacattcttgcgtgaagtgacggaacatcgtatttcaatcatttcttccaacgattatattgtttctccgcaatcttctcacgctctggctaattcattgcaaaccaaaatcattaatgtcgataatgctgggcattttcttgatagagagggctttacccgtctgttacctgtctatgatgctctaaaaaccatcgtttcaggatgaaaataaagagatgaaatcctgccaatgcctcagtttattttatttaatctgaggcattggcgcatctggtgtgtaaagatattaaatataaaagaccaatgatgtattttaaaaaacgatggttaattataaggtttgactatcgtcaataatgggaacaatataaaaacacgcattttagtgacgtgatttgatattgattgatttaatttgtgatttactgttattgatgtttttaaataaataatgtcagtgttgtgagaggtattgtaggttttgattaaagcgttgtaaccttgtatttagtataaattaatgaatataaatatcttattttaagtatatctatatctggatgtttatatagaggtgagaatataaattatataaggaataaattatggcacctgtcgatttaacttctactgctaatcaaagtcatgatgatttaattaacgtgaattttgaccataaagtagggaaatattctgctaaggatttcaaatctgactggggtatttcaccttcagcttcgtcaggtcttaatcaaggccgtttaaatattgttgttgatcctcaacatgatcgaaataaagtactagagataacttatcttgctaatatcgtcagttccaaagcgggaacatcctttgatgtgcctctgaaaggtgctcatcaggcgttatggctacaatataaggtgatgttcagtaaagactttatgtgggtcaaaggtggtaagttgccggggctggcaggtggtgatcgcccgtcagggtgcatagataatggagattttgatggattcagtagtcgtttaatgtggcgagagcgaggggaattgaagggatatctctattatcctgagaaagaatcacgatgcggtgattattttaaatttgatatcacgttaaataaaggagtctggtataccttaacccaatacgtaaaactgaatagcatcggcaaacatgatggtatttatatacaatatgttaatgataaagaagtatttaaattgaaggatgtaaaatggcgtaatgaagggaatgtttttatagatgctataaaatggagttcattttttggtggttcaacgttagactgggctcctccggtagagcaatatgcttattttgacaattttattgtcagtatagaaaaaccgaatagtattaaatagctattctgatgaaattaaaacttaagattttaaaattagccaattaattcaagaatattcttataatgtacaaaaaatatttatctttttgcccacacgctcagcgtgtgggctactgggtatttttacggtgtggcgaaaggattgatttatcacctatagcgtttaaactgtcggccttgaacgcacattgaagtatacaaggttatgttatctactcatgaatatgcaaacgatcttattttgtttgctttgattgttgactgtggatcgttcagtaaagcggcagaaagcgcaggtatcactagttcagtcatcagtaagcgtattgggcgtctggaaatcccttggcgcacgtcttttgtatcgtactacacgtagccttacattgactgaaaatgggcgagtgctttatcaacatgccaaggaaataagtagccgaattcaagatgcattatatgtggtaagtgagaaaagtgatgaattgacgggagtgatccgtatgtcagtacccacagtttcaggcgaattgctgctgagtgaaaaagttgctgagttttgtagtttgcatcctaaattgaaagttgagatacggttagaaaatcatttcgctgatttggtcaatgaaagaatcgatctggcaattcgtactggcacgatgccggattccagtttaattgccaggcctatcttgaattcgcgctgggtgattgtatgttctcccggctatctggaaatgtatccgcaactcaaatccgcggaagatcttctcaatcataactgtctcacttatacccatcaggaaagcggtacggccaactggttgatgaaacagcctgatagccgggatatctacgaattacaggtaaatggaaatttttcctcaaataatgcattggcaatccgcaaagctgtattgggtgggttcggtattgcaatggttccgcgtgtcatggtgtatgaagatttgcagacaggaaaattggtggaaatacttaagggatatagtggaaaagttttgggtgtttatgctgtttatccttatacccgaaatttacctttgaaaatccgaatgttgattgagcatattatgatctcttacaaaaatatcagtcattatttttgatattcctctctgctgataactaatattcagcagagattatgtcatttttggatatagtctattgaaaattcatgtctaattagtgtgatgtaaccgcttttattatttcaatgatgcatgcatccatatgatttttatgatgtttaatcatatccgtatgacatgataatttcgccgaaaatttatattattccttattgttaaaaaatagtgacgtaggagcttaggaaaggttgtgattataatggcgtcgttatgaagaattaactttttagctacattctttgccttataaaaatagtcactatgaggattttatgcccttatttttcagcattgctccgattgtcctgctgatttggatgatgaccaagcgtaacggtattccatcctatatggctctgccattgactgcggttatagtttatttcacacaactattttggtttgaatcttcgtcattattgttacatgcaaacatcattacggctttggtttccgttcttactcctattaccattatcttaggcgcaatattacttaataaactgatgcaaatcagcggagccgaagatgttgtacgcaactggctggaaaatatcagtcccaaccccgtcgctcagttgatgattattggttgggcttttgcttttatgattgaaggagccagtggttttggtacaccagcggcgattgccgctccaatattggttggtttgggattcaatcccttgcgtgttgctttgctgactttggtgatgaattctgtacccgtttctttcggcgcggtggggactcccacatggttcggtttcgccaaccttggcttacctgatggcaatttattagaaattgggcgcttaagtgcgttgattcactttgtcgctggctttgtcattccgttactggcactgcggtttattgtgtcgtggcaggaaattcgtggaaacatcctatttatcttcttaagtattttgagctgtaccacgccttatttgttattagctcaggtcaattatgagtttcctgcattgataggcggtgcgattggactggctctgtcagtattatttgctcgcttgggtatcggaataaaacgttacgagaaaaaaggtactgttcgggttgtgcctttcagcaagattatcaaggcgatgatgccaaccttgttattaattgtgatcctgataattacccgtattcaccaattagggatcaaggagctattgaacaatgccgatatccagtggcaattgaatttgggatggttaggtgaacttaatgtcagtaaatctctgattattaacttacaacaagtgttgggtacgtcagcttctgccagctacaaaatattatatgcaccggcaattatcccgttcctgttggttgtgctgttgtgcatcccactttttcagctgaaccgctatcaggtaaaacagatgttctgtgaaacaggatcacggattttcaagccattcattgcgctgtttggtgcattagtgatggtcaacatcatgatgttgggcggagaaaatgcaccagtgattatcattggtaaggcattggccgtaatgacgggggaaagttggctcctgttctcttcgttccttggggcgctcggctcattcttttcgggatccaataccgtttctaacctgacattcggcggaattcagtattccatcgccctgaacggcggaatgaatgccaatttgatgctggcgctccaatctgttggtggtgctatgggcaatatgatttgtctgaacaatattattgctgtctgctctattttgggtatcgccaatgcagagggacaaatcatgaaaaaaaccattttacccatgctggtttatggggccatcgcggctgttatggccctgattctgacattctaaaaatgcgcaaataagttctcaacattaaggtacatattatgattatttccgcttcaactgattatcgggcagcagcacaggccaaattaccgccttttctgtttcactatatcgatggcggagcttatgcagagcatacccttaaacgtaataccgaagatttatctagcattgagttgcgccagcgtgtattgaaaaatatgtctgaactgaacctggaaacccgtttatttggggaaaaaatggcaatgcccgtggcgttggctcctgtgggtttgtccggtatgtatgcacgtcgtggtgaagtgcaggcagcacgggctgcggccaaaaagggaattccgtttactttatctactgtatcggtatgcccgattgaagaagtagcttcagctattgaccgtccaatatggtttcagctttatgtactgaaagatcgtggttttatgcgcaatgtactggagagggcgcaggcggcgggagttaaaaatttggtgtttaccgttgatatgccgattcctggagcgcgctatcgtgatgcacattctggcatgagtggcccgaatgcttccatgagacaaatcttgcaagcgatgactcatcctcaatgggcatgggatgtggggctaatgggcaagccgcatgatctcggcaatatttccgcgtaccgtggtataccaaccaagctaaaagattacattggctggttgggaaataattttgatccgtcaatatcctggaaagacttggaatggatccgcgatttctggaaagggccaatgattctcaaaggtattcttgatccagaagatgccaaagatgctgtgcgttttggtgctgatgggattgtggtttccaaccatgggggacgccagcttgatggtgttttatcgacggcgcgtgctttgccagcgattgcagatgctgtcaagaatgacatcaccattctgactgattctggtatccgtactggattagatgtggtgagaatgctcgctttgggagcggatagtgtcttgttggggcgcgcttttgtttacgcgctggcagcagcaggggaagccggtgtttccaatctgctggatctgattgataaagagatgcgagtagcaatgacattgacaggtgcgaagtcaattgcagagatcaattcaaatttgctggtaggcaagcaaggttaatcaattatagctgttgtttatggtcagcagaggttattctgctgaccgacactcaattagattccgatgggacgatacccctgccattccggtttatcaggctgaccgtcaggattttcaactaaatggatgtaatagctattcactgaccccaaaagcaagcagtcatcaacatctttcaggttatctttatgcagttggccgtaaccagcaagtaagctttctttggctttttgtttagcttcttcaactgtgcgggctacaaagaacccgaactcatgggcttctgccagtgaatctttttggtagcctccaacgttgacgaaatagagctgcatttctccaggatattcatcatgactgagcgtaatatcgtaaccgtcagcccatgtgatgggcatataaccatccagatgcagtttatctttatcgccaaaccagacctcacgtaatacaggataggctttttcgacctgatccactgcaacaaattggacatcgtgaacttcgatattggattttccggcattgccacccagataaaacatatataaccgagtcatattatctcttatgttataattttataatgtcattgtttgtaacaagtggagaattactggtcttcaagcaatatttgcccatgggaaaagagttttgcttttccagtcaaataaacgcgattgccgtctgttttacataatatatcgcctcctcgttcggagagttgacgtgcatggagtattgatttattgagcctttctccccagaagggcgtgagaacacagtgggttgaacccgtcacgggatcttcattgacaccttttgctggagcaaaataacgtgaaacaaaatcaacaggtgactcaccgggagcggtaatggtaagcccagctaagggaagagctgcgattttattaaagtcaggttgggtattgagaacttgatcagcagaatccatcacgcaaatatagcgatcatgtgaggcgaacacttcgttgatattttgccccagagcgtcctgcataatagagacgagcgttttttcttcatgacaatcagtagcggcaaaatccaatgtgaaaataccctcttgatgagatacacgaagctcaccggaaaggcttgtgaacgtgatcgggttatcttggcaagattggtgttcgatgaggacgaaagcggttgccagcgtcccatgcccacataaattcacttcgactttaggtgtaaaccaacgtagttgatttcctaccagaaaggctgtctctgaaagattaatttctgcggcaatggcaatcaacgcttcatctgtcagccatttatccagcaaaacaacagcggcagggttgccagaaaaggatttttccgtgaaagcatcgacatgataaatagggtatgaaggcatcaaaatctcactttattctaataaaaaatcggactcagcatgttgaagttacttttgtttgtaaagggttattttttccgaacatagatctacctataacggggtgttgacctgagcccataatggctattaaataataatttttagttatagttacattaggggaatatatgaaaatcaaaggagtttcttgcttgttttttattttatcaatgggctgtacccaagcgttggcgctggattttagctacaaaagtgagatgcctactgataacaaaccttcagaggagtatctgaaaaaaagagcggggttagactccaaatattggaatgttgatacgctgacacaggataacgtgctggcggaaaaacgagaggaagagatgaaacagtacaacaaaaaattcgagaataaaaatggaatcggactttcttatgattgggagagtaaaaacctaaaatcctttcaacatatgcaacaaacgagtcatctctccaatcgccgctgttatcgagctactcgacagaaattagaaaaagactttggaaatagctattcttattcagatattgctgatacttgtggttcttttcactgagccagtgacgggcggcggatgatacgatagtgtttagctaactgtggacaccggaagagtgcgaaaggagtcgcatataaaaactaaagccatctcagcataatggagatggcttgggtatatctatttccctactcaattaattgcggcttttgtcataattaagatttcgtttccgcttggtgaagattgctcattaaacggcgaatcgggatgattaaaacaagcagaacagcagaacagataatcaacgatagtgaaacattggaaaacaattctggcaggctatcaagtttatctgcgcgcacgttaccaccaatcaggccagcagccagatttcccagtgcgctggcacagaaccataatcccattacctgtccacgcatgcgggaaggtgccagtacggtcatggttgccagtccgattggactgaggcaaagttcacccagtgtcagcaaaagaatactaaaaatcagccatagaggggaaaccgtccccccagttgccagtacgtactgtgatgcaagcatcatgatgccaaaaccacccgccgcaaacagcatagcaatcataaacttaccgatactgcttgggttcatattacgttttgccagcataggccacagccagctaaatagcggtgccagcagaataatgtacagaggattaatcgactggaaccagacggccggaatttcataacccagtactatacggtcagtgtagtctttggcgaataagttaaatgaagttggtttttgctcaaatgctgaccagaatagagcggctgaaaccagcaggataaaacaaatgaacaagcgggttttctcattgcggtctaaccctgcaaataggaataaataggcaaaatagaggataacgcttaatgagataatatacaccagcacattggcaaccatcactgggttaaagggaataacgcccatagctactgttgcaacaatcgaacagataacgactaagagtgcgccgatccatttaccaacgtttttgcgttttaccattggatgatcccaactggaatccagacccgcttctttatcataacggcgcattagtgggatagtgtaaaagcggaaaatcagcagggcgactaacatacctaatccaccaacaccaaagccccagtgccagccgtaatccttcaccagccaacctgtaattaatgcagcgatcaaggaacccagattgatgcccatataaaacagggagaaaccaccatcacgacggggatcatcttttttgtacagagttcctaccatgacggtcacacaggtcttgaacaggccagtaccaatagtaatgagcagcagcccgataaagaacagattattgttccagatccccgataatgcgatggacaagtgccctaatgcgataataatcgagccataccagactgcaagtcgttgacctaaccagttgtcggctaaccagccgcctgggagtgatgtcaggtaaatactgccggcaaaaattccgacaatggcggatgcctgctcacgagggatacccattcccccttcaaaaattgccgcagacatgaataaaatcagaagggggcgaatgccataaaatgaaaaacgttcccacatttctgtcataaaaagggcgcttagtggataaggatgcccaaaaaaggttctatgatttccattcttatttgaagattgcattgaataattcttcccagaaacccatctttgtgatggagatattttacaagttaaaataaaaatcactttataatcacgatgaacgaaattattaacatgtttttataaagttgattacttaattgttggtatagttttaacatgttctctacttttttcattggcaagcaacacattttctatttcatattccattttttagaacgaaagtcgataagaatcgcatttttagaatttaatagaggtggtgtgatatgcagctattgacttgtggttttttttatcggctatgatattttttataaaatgaattataaaacaatatgttacttgatgatgatttcggagtgaatattcttctgcgttagcaagaaagaataaaaattaatcgtgacaaggtaacataagggcggtttatttctctttatgtggtttacagtcactgtgggaatgtaaatcaatcgaagaataaataggattaaaaaaacaccacgttggcggtgaaaaaaaacacaaaatataggttggaaatggttgtaacaaatgcttttattaacatttttgtaatatttaccatatcgcaacatgatggattataactgaaaatacggattgtcacctgatatgagcaataagaaatgagtaataaatgaaaaaaaatttcgttttcaataacagataggtgaaaacattgtcgttttggtgtacttcggtttgtatcttgcaaagagagaaaaatcatggctgccattcgatgaaatggcagccgaataacgttagttagtgaatgttattgttgtcatcgtacagggatggcatgccttcgggacgtgttttaaaacgacggtgtagccacatgtactggtctggtgcctgcataatctcccgttcaaccaccttgttcataaatgctgccgcttcgacttcatcgttttttggaaaaccttccaccgctggctggatcatcagctcataaccttttccatccggcaatctacggggagtaaaagggagcagggctgggtcggacaaacggacaagaatcgaagtacccgtcgttgttgcggcgtgttcaactgcgaataatggggcgaatacgcttttacgtgggccataatcatggtctggcgcataccaaaccatttcaccatttttcagacaacggatcatgcccttcacatcttttctgtccagcatatatttattggaacgcagtcgtccccaagtttgcagccaatccatgacgggattgtcatttgggcgataaacaccgatccccggatttagcagacccaggatacgtgcacccaattccagtgttagaaaatggatcccaataacaatgaatccctgattactggacagcactttttggagattttcttctcctgtgattttgaaccaacgcttgattctccagtcaggccaaaaccatgctatgccagtttcaaacaaccccataccaacagactcaaaatttctgactagtaattcattccgtttttctggtgacatatcagggaaacagagagctaaattgcgttcagcgattttggctcgttttttcaaaaagcgctgtgaaagccggccaagccgggttcctatccagtaaatcaccggataagggagtaaaaccagtaaataaagtatcccgatacctagccaagtcagccaataacgggggtgtaaaaatgaacgttgaaaagatggtgcttgtatcatgtgttttcagtgtgttaaggataacatttaactaaaagccggactcgtcaggctccaagaagtaatatcggtgtattgtgacattttttagtgaaatatcgaaatattgagacattaaatgcttaattgttgataaatcaagcgccatatccactatcgggtaatgctgcgccaggccatgattatgatattcctgcgcattatattcaaatgctgttttacatctgttggacacgagttgggcgttgaaatgatgagcaagcactaattactatcagaatagcaacgttaaaaatcactactcgctaaaggccattttcgttatgatatccggctatcaatgggatagccattgaagttttgattcttttattaccgaaattcaggaaagtacaccatgtcagtgttacataaccgtatttctaataaagagctgaaagagcgcatgttagctgaaactgagccgcgcacgactatctctttttataaatattttacgatttccgaactacaggcttttcgcgatagcctgtatcaaaaatttaccgagttgtctgtttttgggcggatttacattgctaaagaaggcatcaatgcgcaaatcagcgtgccttctaaaaatgttgatgctttgaaagcgttattggatgcgactgatccggctttatgtcatttgcggctgaatattgcgctggaagatgatggcaagtcattttgggtattgcgcatgaaattgcgtgagcgtattgttgctgatggtatcgaagatgaaacctttaatccatcaagcacaggcgaatacttaaaagcggaacaggttaaccaaatgctggatgatcctgataccttattcgtcgatatgcgtaaccactacgaatatgaagtggggcatttcgaaaacgctatcgaaattccttcagatacatttcgtgagcaattgccaatggcagtagaaatgttgaaggataataaagacaaaaatatcgttatgtattgtactggtggaattcgttgtgaaaaagctagtgcttacatgctgcataatggttttgacaaagtctaccacgtagaaggtggcgttattgagtatgcccgtaaagcgaaagaacaggggttacctgtccgttttatgggtaaaaactttgtttttgatgagcgtatgggtgagcgcatttctgaagatatcattgcgcactgtcatcagtgcggtaccgcctgtgatagccatatcaattgtaaaaatgatggttgtcacctgttgttcatccagtgtctctcctgcgcagagcggtttgaaggatgttgcagtgatatttgtcgggaagagatgaaactgcctgaagaagaacagcgttttcgtcgggcgggaagagaaaatggggcaaaaatttttaataagtctcgctatcgtttaaatgatggtctgaatattacatcacgggaatccattaagtgataaatgttttttaagtgataagttcgcggcaatcagaatgttggcgtaaatagcatctcattatttacgccaacattgttactttagaagatttagcagatatatttaaaaatattgtaaataaaaagtaactctattttgttagaaatgccgattttttctataatatgtcttttgtgtgaataaaccgtactattgctgatttttagcattttagcaattttatgtgtatcggtctctcgcatccaataatggataattcgattttcctgaaggctgaaaatagaactttgtgtattaaaattggcaaaataacgttgaatatcgtgttctgccatttcttttatccgaaccaataatgtgctgagattccttttgggtaaaataaaatccttatttgtcaattgtatgctcgtatcgcacaagggatatggtttgtcgatgtaggtataaatacgggcatcattaactaacgaaataaataatttcagttgttcacaatattctctgtggtggccataattcgtcaagttcactaaaatgacatctggagaaaatacaggcaaaatattcatggcgtcatgaattgatacagccccgattgagaaaatatctatattttctttcagagattcaataattcctaaacgtgtataatggcacttatcaatgactaacaatttcattaactgaacatccttgttcttctatggttattatttaaataaaaaaatggcttaataattaagaattaggcggatgagaatgactgtatgatacagtattatgaaggataataaactatgcaaataattcagttggctgatatttgttcaaatgttcgaattggacactcaacatactgagtgtccaaattattttctaatgttcaagatgattattaatgtttaatatgatcaagctgactgtattcagatgcttctatcttttcaatcccagcctgcaaaatgaggatgagttgcttggctactcctgttgtcaaccacaatgttttgtcaatattgacattgcctggggtttgatcttgggaggataagtaatgaagacgtatcatcattgcgtcataggcgtcgacagtgctgatgtcccaacctacaacaggatgagtttgaataatttcatttttttgttccatataacctcctaatcagactacagcattcttattgatagaattgactaagagcagaaaatctcatcaaggatgagcaatagcagtataaccctttttagcaatctaagaaggagaaagagcgagattttttgcattatcactaattgggattattgtaagggataccaacgacttatttaggtaagtgtaaacgtgcgaaaataagaacactttccgcacgggtagcagtaaaaaattattcacatacctttacttcccatctggcatcctcgtcggccagaaatgggattaatttctcatcaccgcattcgatatactctgtgactggcgtaggtttacgtgtgagttcaacgaagccttcattaacgggcagaccataaaacttagggccattcaaagagcagaatgcttcaaagtgagctattgcctccatttcttcaaaaacggtggcataggctgcaagagcagtaggcgcattgaagacgcccgcacaaccgcaggaagattctttgcgatgctgtaaatgaggggctgaatctgttcccagaaagaatcgattacagccactggctaccgcggaacgcaatgcttcttgatggatattgcgctttaataccggtaaacagtagaggtgaggacgaataccgccaaccaacatgtgattacgattaaacattaagtgttgtggtgtcagtgttgccgctaatttatcattgcctgaaagaatgtattcggcggcttccttggttgtaatatgctcaaaaacaactttcaattcaggaaactgcttacgcaatggttccatcacctgctctataaaccgagcttcccgatcaaaaatatcaatatgggatgcagtgacttcaccatgaatcagcagaggcactcccaattcttccnnnnnnnnnnnnnnnnnnnnnnnnn

SEQ ID NO: 16899 - DNA, 853 bp, Xenorhabdus bovienii
  unsure (1)..(853): unsure at all n locations
tgctcaaaancacttcaaattcaggaaactgcttacgcaatggttccatcacctgctctataaaccgagcttcccgnatcaaaaatatcaatatgggatgcagtgacttcaccatgaatcagcagaggcactcncaattcttccatggtttccaataagggatagatctttttggtatcagaaacaccgtggctggaattggttgttgcattggccggataaagtttacaggcagtaaagatcccttctttataaccaatttcaatttgtgaactgtctgttgagtcagtcaagtagcaggtcatgaggggttggaaatgatggtctgacggaatggcggcaattatccgatccctataggctttggcactggcaacatctgtcactggaggggctaggttgggcatgacaatagctcggccaaagaaacggctggtatgaggaacaatgatttttagcatatcatcatcgcggaaatggacatgccagtcgtcagggcggcggattttaattgtatatgattcagtggtcatggaaccggctccagaatataagtggaaaaatgatggatgctgattcagcactccttaagccggaggaggatgataaaacgaaaatagctaaatagctattattgaatgataaaattctatgaattttgaaaaattaatattttaaatattatttgctagggtagggtattcagaggaaatttatcgtatcaaaaaacggaaaaaatagaagtaataacacgagggtgaattgaatttggctcctccaactggactcgaaccagtgacatacggattaacagtccgccgttctaccaactgaactatggaggaattccttc

SEQ ID NO: 16900 - DNA, 214775 bp, Xenorhabdus bovienii
  unsure (1)..(214775): unsure at all n locations
nnnccgtgagccgaaccgtcgtactcagattatggttggtgttgcttataacgcggatattgatgaagtgaaaagagtgctgggtgatgtggttaaagcggacaaacgcattcaacatgaaaaaggtatcaccattcgtctgcacgaaatggcaccttcatcactgaactttattgtgcgtgtatggacaagcaatgatgatgcctggagtgtttactgggatctgatggaaggtttcaaacgtactctggatcagcacaatatcagcattccattcccacaaatggatgtctatctgcatcagcagcaagctgccgtacagaagaagatagacgaataataaaagtagcttggtgtgagtagtgaaaattctcacaccaagcttaagcagttttacctgcttcttcttccatcatgctgatatttgactatattattgatatttattattaaattatctaatgatgaataagaattattcatttttactcatatatgatctttcctaatatgcatatataacatagctaattgagtaattattaggggcttctgcatgctttcgacatttatacagggcttttttcttggtgctgccatgatcctcccgcttggaccacaaaatgtttttgtgatgcagcagggaagtagaaaacagtttcatttaatgagcgcaacgttatgtgccaccagcgacattgttctcatcacggcgggggtatttggaggaagtgctttgcttgggcaatcggcgttcctgctgcaagcggtgacatggggcggagtggcatttttgctatggtatggatggagtgcttttcgagtggcgttatcagcgaatatcgaactctcccgttctgagaatattgtccagaaccgctggcgagtcatcgtgacattatttgctgtaacgtggctgaatccgcatgtttatctggatacctttgtggtattaggtagcgtgggaggaggactgtcatcggaacttagaccgtggtttaccgttggggctgctacggcatccataagctggttttttgcattgtcaattctggctgcctggttttcacccgtactcaatcagcctcgatcacaaagaatcattaacctctttgttggttgtgtgatgtggtatatcgcatggagtttgctcaaacagggattacagattttttattgagttacatactactttatagatagtgtgctaatgtttctggaaagcgctttgtcttactgtaaactgtaaaaagtgcctgtttacttgttgtatccgaaggaggttttgtgaaacataaatcactgatattcgctgcaatgatggcagtaggaagtttgtcctgtatggctgcttctgctgctgaattaccccccgccccacatatatctacttctggtaatgcgatcatcaaagcagcgccggatatagcgactttgatgatccatgtgaaagtgactcaaaaaagtgcagcagacgcaaagcagaaagtggatgaacgcgtcgcaaaatattttgatttcttgaaaaccaatggtattgacaagaaagagattaatgcggccaatttacgcactcagccagaatatcaatacgaacaaaagacgggtaaatcaactattacgggttatagtgcatcacgttcagttgaagtcaaagttcgtcagttggatcaactgagtacattattggatggtgcattgaaagcaggattgaatgagatcagttcagtgcagttcagtgtcgataatccacagcgttatcgtgatgaagctagacagaaagccattgaaaatgcgattcagcaggcgactgcactggcaaaaggcttcaacagcaagttaggccctgtgtatagcgtcacttatcgttcccctgaagccgtgccttttccaatgagccgcctgaaatacaggtcagcgcttatggccgcagctcctgctgaggattcagccagtgaaacttatgaaccacaaagcatcgaattctctgatcaggttgaagcggtttttgaattgcaacgctaactaatttcatcttcctgacgtaacatctggcgccctagtttcagtagggtgtcagtgacttttctcatcgcgccactttctggagcaaaacggtgccaataaagcatacggcgctgacatagccctggagttaaatcaattaattcgccggcttgcagctctttgtcgacttgcaggtgtgggatcatgcagcatgtcgagccttgttttgctaattgaacgaatgcttcagaggaattcacaatatggcagggaacactgcccggtgataaatcaaaatgctgctgtaaaaatgcctgatgcatatcatccaaatggtcgaatgcaaccgcaggggcttttagtaaagctgaacgagtgacgccattcggaaagaatcgttcagcgaatttaggcgatgccacaaacagataatcgagggcgcctaatttatccaccaggcagcttggcagtggctgtgattgaatactgatagctccgacgacttctccgcgccgcaaactttcttgagtacgggtctcatcttccacctgaatattgagtcggatagggacatcggataaaacaggatggagcgctggcaagagccacgttgccaaactgtcggcattgactgcaagtgagagcagtaacgggatatcgttaccattttcatcgccgagccattgtgcttccagcaattctacctgatgtaatagtgcgagcagtttttgtccttgttctgtagggtgagggggaacggtgcgtactaataagggctgcccaaacatattctctaattgcttgatacgttgggataccgctgactgggtaatacagagtttttgcgccgcacgctcgaaaccgcgctctcggatcactgtatccaacgcttgtagggatcggtaatcaggacgtttcattgaaaatcagattctccattcttgctcagttttctgtgccatagggttctatatttttttgtgctgcacagcactatgccatattttttcgccgggtgaggcaaaatattgtttatactggtggccggatttttccttgtaactgattataggctgtgattgatatgacacaggacgaactgaaaaaagcagtaggttgggcagcactggaatacgtcaaacccggcacaatcgtaggtgttggtacaggttcaacggcatcgcatttcattgatgcattagggacaatcaaaaatcaaatcgaaggcgcagtgtccagctcggaagcatcgactgaaaaattaaaaagtctgggcattcccatttttgactgtaatgaagttgatagcttggatatttatgttgatggtgctgacgaaatcaatggccatatgcatatgatcaagggaggcggcgcagcattgacgcgagaaaaaattattgccgctgttgcaaagaaatttatctgtgtcattgatgaatcaaaacaagtcgatgtgctgggtaaattcccgctgccggttgaggttatcccaatggcgcgctcttacgttgctcgtgaactggtgaaattaggtggaaccccagtttatcgccagaatgtggtcacggataatggcaatgtcattctggatgttcataatcttgccattcttgatcccgttgcgttggaaaataaaataaatggtatcgttggcgtggtgacggtcggcctatttgcccgtcgtggtgctgacgtggtgctggtcgggacagcggatggcgttaaaacgatcgcagaataatcgtttattggggcagaataatctgcccttaaaatatttccatgtttttttaaaaaattaaaatttagtgagatatatcacattctagcctaaaaattcctcaaagttctgtttttagactgtaacaagtcatattactacgtataacaacttttttacttcgatttaccctgttgcgtgagcaaacgattgtattgccgttgctgttttttttgttattttggtggaattcattatggatattctgaaaattaagacaacgatagggcgggcaaatggtcaaggtatctttagaaaaggataagattaaatttttgctactggaaggcgttcatcagaacacagttgataacctgcgggctgcgggatacagcaatattgaatatcacaaaggggcgttggaacctgaagaattgaaagaagcgattcgtgatgctcgctttgtgggtatccgttctcgtactcaattgactgaagaaattttcgaagcggccgaaaaactggttgctgtgggatgtttctgtatcggcaccaatcaggttgacctgaaagcggctgaaaaacgtggtattcccgtatttaacgcaccattctccaatacacgttccgtggctgagatggtgttgggtgagttactgttgctattacgtcgtattcctattgcaaatgcgaaagcacacagaggaatatgggataaacaggccaaaggctgttatgaagcacgaggtaagaagctcggcattattggttacggtcatatcggtacacagcttggcattctggctgaaaatatcggcatgcatgttcatttctatgatattgaaaataaactgccgttgggaaatgcacagcaagtacatcatctgtctgaattgttgaatatgagcgatgttgtcagcctgcatgtacctgaaacaggctcaacaaaaaacatgatcggcgtggaagagctggagctgatgaagccgggtgcaatcctgattaatgcctcacgtggcatggtagtggatattcctgcactccatgacgcgctggagagcgagcacctttccggtgcggcacttgatgtgtttccgagtgaaccagcaacgaacaatgagcctttcatttcgcctctgagcaaatttgataatgtattgctgactccgcatattggcggatcaacacaagaagcccaagagaatattggttacgaagtcgcgggtaaactggtcaaatattctgacaatggttctacgctgtcagcggtcaacttccctgaagtttcactgcctgttcatgccaaagatactcaccgactactgcatatccatgagaaccgtcctggcattttgactagcatcaaccaagttttcaccgatcaggaaatcaatattgaggcacaatacctgcgtaccaacggagatattggctatgtggtcattgatatcacgacgcaaaattcggctcaggctgaaatggttctgcaaaacctgaaagctctgcctggcacgatccgctctcgcctgctttactgattgcctgggcgaatactatgaaaaatggggctatcgtagaaacagtagcccctgaaaagaataaactgtcattaccagcgccatattttttcaggcgtaatgatttctggcagaggaatatcccagcttgcacttggcaatgaattaactaattggaaatcgtgcgccaacccaatcggataaaaattctgctgttgccatttggcgagcgttctgtcgtagaaaccgcctcccatccccaaacgttgccctgtgctatcaaaagccaccagtggaataaacatcacatcaagctcagagacgggcaaaacctgccgaacatctaatggtggttcttctatgttaaaacgattgtagtggagggaagtctcaggatggtaatgcaggaacagcagatgatgttgactgaatgggtgcaatacgggtagataaacttgtttattttgttgccaaaactgctgaatcagcggtcgagtgtctaattcaccatcaaaggcgagatacagggcaatcttgttcgcctgctggatcttgggatgagacatggcattttgagcgacctgctgggcaaattgcgattgctgctctggggatagattttgacgtaactgtcgaatttgttttcttatggattttcggagagataaaaaaggatctgattgcatgaaacctgcctattaatgcagaaaaggatacaaaacagataaataagggggttctccaagatgccgcggcaggtggtaacccttgaacccttggttcaaggtgaacgtagtgtcgcccctattaggcttcttggtctagccaagcatgctcacaagaaacggagcaccacattctataggtatgaaatatcggctcaggggacttacctgctcacgcacacctcagagaaattttgtagcacttaaaaccaatcagttaagaattcatccgtcaagaacctgtctgtcgggatccattcatcaggctttaagcaacgctatagagcctattgtatggaactaaatggagaaagcaactgcttatgttcatgtatagtgactactgcctgatttatcaacaaggatcagtttattgacagctaggaggtcaggtaattttaccttgttctaacaaagcttgttcaatagtctgctggagcatttttattttttgttccatattgtaggagtaatcacgggttttcatcttttcctgtgctaactcgtgacaaacgttcagcgccacaataaaaaccagttgctcagtgttcgttactctggtgcgttctttgaggttatgcaaacgctgatcaagttccttcgcagcagcttgcaaagcctctacctgctctggtggacaattgacacgtaatgatcgcccaaaaatctgaatatctactggttgtgcagacatgacaccttcctgatttattactgtgccgataccttgattctggcataaaagcagattttggtattaaaacaaggccgacaacaatcattaccgtacaataccaaaaggcaaccctccttatatcggtgtgtgctgtctggtatagcgactccccttgatggtagcatagcatgaacttatatcgccaacgatgatcaatatacatgtctatacaaaactcattacctaattatcaatcatttgatgaaattttgcatcaacagtcagttgcgctgacagccgccgaaatgcacggtctaatcagtggcctattatgcggtggaaatcatgacagtagctggcaggcactaatgcatgatcttactaatgatggccttgcattttcacaggtgttggcacagccgatcagggaattatacgaaacgacttttgaatcacttgatgatagtgattttgtttttaatctactgcttcctgatgatgaggcgagtgtttttgactgtgctgatgcgttggcgggatgggtaaatcatttcctgttgggattaggcgtggcgaatccgaagctgacagaaaaacaggaaatacaggaagtcattactgatttacgtaacatcggtatgctgggatacgatgaagacgaagatcaggaagaattgtcccaagctctggaagaagtattggagtacgtccgtgttgcagtacaactctgctacattgccttggcgacaccgaaaacggcaaatagcgtgaaaaaaaatgaaaagccaacgctacactgattggcggttaaccaactaataataatcaaatcgcaggagagggtatgactaaacaagaatatttgtcccgtcgtcaggcattattgtcaaacatggcaccggccagtgcggccattatttttgcagccccgcctgcgatgcggaattcagattgtgaatatccctatcgccagcacagtgatcttctttacctgactgggttcaacgagccggaagcggttcttgttctgatcaaaagtgatgaaaaccacaaccatagcgtgttgtttaaccgtgttcgtgatctaactgcggaaatttggtttggtcgtcggcttggtcaggatgctgcactggaaaaacttggggtggatcgcgccctgccatttgatgatctcagtaaacagctttacctgctactgaatggtttggacgtagtttatcatgcccagggagagtttgaatacgctgacaatatcgtattcagcgccttggatacattgcggaaaaataaccgtcgtaacctcagcgcaccatcaatgatggcagattggcgtccgtggctgcatgaaatgcggctgttcaaatcggcagccgaactggacatcatgcgcaaggcaggcgacatcagtgcgaaggctcatacgagagccatgcagaattgtcgcccaggcatgtttgaatatcagcttgaggctgaaatccatcatgaatttactcgtcagggagcacgttatcctgcttataacaccatcgttggtgcaggagaaaacgcctgtattctgcattacacagaaaacgagcgccgcatgaaagagggcgatttggtattgatcgatgcgggttgtgaatatgaaggatatgccggcgacattacgcggacattcccggttaacggtaaattcacccgtccccagcgagaaatttatgacattgtgctgcaatctatcaatgtctctcttgaactgtacaggccgggcaccagtattcgcaaagtgacggagcatgtggtgcgcatcatggttgaagggctggtcaaattggggatcatgcatggcgaagtagaacaattgatcgagaccaatgcttatcgtcaatttttcatgcatggtttaagtcattggctgggattggatgtgcacgatgtcgggcattatggcatagatcgcgatcgcattctggaacccggcatggtgctgactgttgaaccagggctttatatcgcgccggatgctgatgtaccaccggaataccgcggtattggtatccgcattgaagacgatattgtaattacggaagtaggcaatgagaatctgaccgagcatgtcgtgaaagatccggatgaaattgaagcactgatggcacaggcgaaacagaattaaaattactgtaatcaggaaatcataatgaacgtgattattgtggggggaggagtggctggtgcaacactggcgctggccatttcttccttaagtcgggggcagttacaggtctctttgattgaatcgacagaaccaacacaagaacatccgggttttgatgcaagagctattgccttggcttatggcacatgccagcgcctgagccaaataggtgtctggcctgtgctgaaagattgcgttaccccaattactcacgttcatgtcagcgatcgaggtcatagcggtttcgttaacattcgagccgatgactatgctattccggcattgggtaatgtcattgaattgcacgatgccgggattcgtctgtttaatctgttaagacaggcatctaatgtcaaacttcactgtccggctaaagtgaattccgttgagcgtctggatacttcggttgtggtcaagctggacaatggcgaaaagatcacgggagagttgttggttgctgccgacggaagctattctgccgtggcgaaagcgtgcaatattccgtggcagcagcaaacttacggtcaggttgccatgattgccaatgtcctgacatctgaacatcctcagggacgggcatttgaacgctttaccgaacacggcccgctggcattgttgcccatgtctgaaggtcgcagcgctttggtatggtgccacccgctggaaaaacagacggaaatcaacgactggagcaatgaggaatttcttcaacaattgcaaaaagcctttggctggcgtttgggtaaaatgctggaaacgggtcaacggcatagttatccactggctttatccactgccagccagcagatcagtcatcgtctggcgttggtaggcaatgcgtcccaaacgttacatccgattgccgggcagggttttaacttaggaatgcgtgatgttatgacactggcacaagtcatttcagcggcggcagattcagggcaagatattggtgcttatgatgttttggctcgttaccagcagcaacgccataccgatcgtgaaacaacgattggcattacggatgggctggtcagaatattcgccaatgactatttccctttgaagatagggcgtaactttggcctgataacgatggaaacgttgtctccgttgcggaatttatttgcccgtcagacactgggttgggttgcccatcactcatcggtagaataaggcagattaagaggaaagaaaaacatgcaatcatttgatgtggtgatcgcagggggcggtatggttggccttgcgctgtcctgtggttttcagggtagcggtttgcgcatcgcgattgtagaagagcacccaccgacaggcacgtttcatgctaacgacgaacatgcgctgcgtgtttctgccatcaatgcagccagtgagcggttattaactcatcttggtgtctggcagcacattactacgatgcgagccagtgcttatcagggtatggaagtccgggatcaggatagttttggtcgcattaaattcgatgcgacagaaaatggtctgacacatcttgggcacatcatcgaaaaccatgtgatccggcaggcactttggcagcaggcggaaagtttgcctgatgtgacgatttttacacccgcatccctcaaaaatgtcgcgtggggagaaaacgaagctttcattactttgtccgatgagcgaatgctcacttcacggctggttgttggtgctgatggtgcgaattcatggctgcgtcaacatgcggatattccactgaccttttgggattatgagcaccatgcgttggtcgccaccattcgtaccgaagaacctcatcaggctgttgcgcgtcaggtctttcatggtgatgggattctggctttcctgccgttgtctgatccccatttatgctcgattgtctggtcactgcctgctgaagctgcgcaacagagcaaagcaatcgacgctgtattatttaatcggcaattgggcgttacatttgatatgcagcttggtcagtgtgaattagtcagtgagcgccaggccattccattgatggggcgctatgcccgtaactttgcagcccatcggttagccctgctgggggatgctgcacatactattcatcctttggcgggacaaggcgttaatttgggatttatggatgtggcagagttgattggagaactgagccgcctgcaccgccaggggaaagatatcggtcagtatctctatctggggcgtttcgaacgccgccgcaagcacagtgcagcggtgatgctggcaggcatgcaagggttccgtcagctatttgatggcaataatccggctaaaaaactattgcgtgatattggattaacgttcgctgatcacttaccgggagtgaaatcgcaactgcttcgtcatgccatggggctaaatgatctccctgattggctgattcctcaaacctcttcggttgaaaaaatctaattctgcttctcattttagattagttttcctcatgttggactaaagtgtgtccagttgatttacttcacactttagtctttttctaataaaaaaagaacgtattctgtgtttcatcaaaaattttgagcgccttcacgcaataaattagataaaaattctgcatgatagtaagtggtttttcaggttattactgtaatgctgctaatttattttatggttcatttccattttcagtgataacttctaactcaaggtatcgtttgcgtcattaaccgctttttttgattcatgatccaacctctgtcggttaatacgccgtatgtttttcaggtcaaaaacattttcatgtcaagaatggaaagagggaaataatgtcaaaacacaccccactatatgatcaacatctggcatacggagcgcgcatggtagattttcatggctggatgatgccccttcaatacggttcacaaatcgacgagcatcacacggtgcgtactgatgctggtatgttcgatgtttcccacatgaccattgtggatctgcatggcacaggttgccgtgattttctccgctatcttctggcaaatgacatcaccaaactgaccgaacagggcaaggcactttataccggaatgttgaatgcctccggtggtgttattgatgacctgatagtctatttcttcactgatgacttctatcgcatggttgtaaattctgcgacccgtgacaaagacttagcgtggattcaacagcatgccacgaattaccccgtcgaaattacggtgcgtgatgacttggcattgatcgcggttcaaggcccgaatgcgcagactaaaacacaatccctgctgaatgatgaacaaaaacaggccgtgacaggcatgaagccttttttcggtgttcaatctggcgatttatttatcgcaacgaccggttataccggcgaagcaggttatgaaattgcgttaccgaaagaacaagctgctgatttttggcagcagttgttggcagtaggcgtcaaacccgccgggttgggcgcacgggatacactacgtctcgaagcgggtatgaacctttatggccaggaaatggatgagaccatttcgcctttagcggccaatatgggatggacgattgcgtggaaaccggaagatcgtcaattcattggccgtgaagcgctggaaagacagcgcgaagtaggtacagaacaactggttggtttaattatgcgcgacaagggcgtattgcgtggtggtttaactgtccacttcaccgataaagcgggtgaaatgcggtctggtgtcattaccagcggaacattctctccaactttgggattcagcatagctcttgcacgggttcctcagggaattggagaacaagcgattgttcagatccgtaaccgtgaaatgcctgttcaggtggttaaaccgggttttgtacggatgggcaaaccgctcgtagagtaattttggtcgtaacatttttattaatgaattaaaaataaggagatggcaacgatgagtcatgtaccagcagaattaaaatatacctcatcacacgaatgggttcgtgtggaagaaaacggtgaatacactgtaggtattaccgaacacgctcaggaactcttgggtgatatggtattcgttgatttgcctgaagtcggtgcagttgtaaatagtggtagtgactgtgctgttgtagaatcagtcaaagcggcttctgatatttatgcccccttgagtggtgaagttaccgctgttaattcagagttggaaagttctcctgaattagtcaacagtgaaccttataacgaaggttggctgttccgccttaagatctctgacgagagtgaactcacccatctgcttgatgcggaaggttatcagtcacttttggcagaagaagaataatgatgactatcgccccatatcacgctgtgaatggggcgttttttatgtgtgccgtttttagctagtttcaggaaattatcatcaatgactcagacactaatccaacttgaaaatcaaggtgaattcactcgtcgccacattggttcttctgctgaacagcaaaaagagatgctggcgacagttggtgcaaattctcttgacgatctgacgaataaaatcgttcctcgtgatatcgcattgtcagaaccgcctgctgtaggcgaaggcgcgacagaacaacaggcactggctgaactgaaagtgatggccagccagaacaggcgttatcaatcttatatcggcatgggatacgcgccatcggtactccctccggttattctgcgtaatttgctggagaacccaggctggtacacggcatataccccgtatcagccagaagtttcccaaggccgtcttgaagccttactgaacttccagcaagtcactattgatctaaccggattggatcttgcttctgcctcattactggatgaagctacggcagcggctgaagctatggcgatggcaaaacgggttagtaagttgaaaggcgcagagcgtttctttgtggcggatgatattcatccacagacgctggacgttgttcgtacccgtgcggaaacatttggatttgaagtcattgttgatgaagccgaaaaagtactggaactggaaggcgtcttcggtgtcctgctacaacaggttggtacaacgggcgaagttcatgattacagtgttctgattgcaaaactgaaagagaaaaagatcattgtcagtgtcgcggcggatttcatggcactggtcatgttgactgcgccgggtaaacaaggtgctgacatggtatttggtgcggcacagcgttttggtgtcccgatgggatacggcggcccacatgctgcattctttgtctgccgtgatgaattcaagcgttccatgccgggtcgcattattggcgtttcccgtgacgcggcgggtaaccgcgctctgcggatggccatgcaaacccgtgaacagcatatccgtcgcgaaaaagcgaactccaatatctgtacctcgcaagttctgctggctaatattgctggcatgtacgcggtttaccacggtgctgaaggcttgaagagaatcgctggccgtattcaccgattgaccgacattctggccgctggcctgcaaaaagcgggcataacactgcgtcataaaacatggtttgatacgctgaccgttgaagttgcagataaaacaccggtgctggcacgggcggagaaggctcaaattaacctgcgtactgatattcttggtgcggttggtgtggcattgagtgagaaaaccagccgcgacgatttgcagacgctgttccaagtcctgactggctctgatgctatgctggatatcgatacgcttgatagtgaaatgtcggcaggcagtcaatctattccggcttcaatgctgcgcaatgatgacatcctgacgcatgacaacttccgccgttatcacagcgaaaccgacatgatgcgctacatgcacagcctggagcgtaaagatctggcattgaatcaggcgatgatcccgctagggtcgtgtaccatgaaactgaatgcggcggctgaaatcatgccgatcacatggcctgaattcactgacatgcatcctttctgtccaccagaacaggcacagggttatcaccaactgatcagccaactctcccattggctagtattgctgactggctacgacgcagtttgtatgcagccaaactccggtgctcagggagaatatgctggtttactcgccattcgtcgctattacgccagtcgtggagaacagcatcgccatatctgcttgattccaagctctgctcacggcacaaaccctgcttccgcgcatatggcgggtatgacagtggtggtggtgaattgtgacaaagaaggtaatattgatctgacagatttacgcgaaaaagcggaaaaacatcgtgatgaactggcctgcatcatggtgacctacccatcgactcacggtgtgtatgaagaaaccatccgtcagatttgcgacatcattcaccagaatggtggtcaggtttaccttgatggtgccaacatgaacgcccaagtcggtattaccacgccgggctttattggtgctgacgtttcccacctgaacctgcataaaaccttttgtatcccacacggtggcggtggcccgggcatggggccgattggtgtgaaaaaacacctcgcgccatttgttccggggcattctgtggtggaaatggacacagtaaccacattgggcgcagtatcagccgcaccatttggcagtgcttccattttgcccattagctggatgtatatccgcatgatgggagcaaaaggactgaaacaagccagccaagttgcgatcctgaatgcgaactacatcgcagctcgcctgaaaggagcttacgaaatcctctataccgggcgtgatggctacgttgcccacgaatgtattctggatattcgcccactgaaagacgaatttggcatcagtgaaatggatatcgccaagcgtttggttgactacggtttccatgcaccaactatgtcattccccgtagcgggaaccttgatggttgagccgacggaatccgaaagcaaagtcgaaatcgatcgctttattgacgcaatgctggcaattcgcgaagaaatcagcaaagtggcaaaaggggagtggccgctggaagacaacccactggtaaatgcgccacatgttcagacagagctggtttctgactgggaacacgcatacagccgtgaaatcgctgtcttcccaacagcagaaaccaaagccaataaatactggccaacggttaaacgtctcgacgatgtatatggtgaccgcaatttacattgctcctgtgcaccgattgaagattatcgttaatctcggttaacaaagaagacgaaagcagtgttgaggaggattcctcacactgctttttcagaaaaattatctatttttattcaatatatgatggttttttcgtaatggaagatcgctatttttgagtcagttgattattttgaaaatttcaatatcattaatcttgaaaatgtaattgagttgtaaagatgtaccattaaaacaaatagcttgaaaccaacaaaggatgacaactattttgaatatcaccactataacgatgattcgtctttcacaagcgtttctctctcaaaaaacctcaacaatgatgcctgtttggatgaaattttatttcttctatagttagaaaaacacttcaatcctaaacataattgtttgtgttgttattaataacgctcaattatcgtttaatgtcgcataaatccttcattatttttcattaaataattttccgaaaattcaaaaataaagtgaaacaacggcctcatatacgtgcggctaaatgttggcacatcttttcaatacttcagttataacgggagaagttaaggttatgtcattaaatagagtcgtgagtactcataaacgagcagaatttcgtacttggtttggattattgatcttaatgttaccggttttattggtcacggtggacaatactattttgggatttgccttgccaaaaattgccagggctttggaaccgagtgcaaatcagcaattatggatcattgatgcttattcattggtactggcaggattgttggtgtctatgggaaatatcggtgatcgtgttggtcaccgtctgctattgctatccggatcattgggattcaccattgtttcagttatgacggcattatcttcctcgccagaacaattaattgccgggcgtgcagctcttggtttttttggtgcaatgttgatgccttcgacactggctttgatcagccatctttttacagatcgtgaacagcgccgattagctattgctatttgggcgactactctcactgttggatcggcacttggccctgttataggcggtgttttattgcagtattttaactggcaagccatttttctattagccgtgcctgtattggtgcctttgttggtttttgcacctattttgttgcctgaatcggacaaaaagcagataggagtcattgatggttatagtgtcttgttatccattattgcaatggctggcattgtgtatgcgattaaacatgttgccagtgatgggtttgaggtcagtgttattgtggagtttgcgattggtcttatcgccggaacgttatttatacgtagacagcagagtctgcaaataccgctgatggatatttccttgttccgtaatggtgcatttactggttcgatcatagtcaatttattgagtctcgggttactgattggctttgtcttttttgccactcagtatctgcaaattgtgcttaatatgaaaccgcttgccgccagtcttgcactggttcccggacaaattatggcaattgttttcggcatggtgatcgtgccgattgcccagagagtgccttcccactggcttgtacctcttttattggctttggcgggaaccgcatttttattgattgcctgtgttggcagtaacctgacttcaatcgtgattgctttcgcattattgagtattggcgtcggtgcgatagcttctgtttccaatgatctggtgctttcagccgtaccttcttccaaggcaggtgccgcctcagcaatcagcgaaacggcctatgaagttggtgttgtattcggtacaaccattctgggtggattggtaacggcgttttatcgtttaaatttgcaattgccgaaaagtatttctcaggaacaagccggtttggctttggaaacgttagctggggcgtatgtgatagcggcttcattaattgaaacggaaggcaggcaattgatggatgccgcagcgcattccttcaccagcgccattcatattactagctggctgacagtggtattggcaggatgtgtagtcttgatggcatcatatcttctgagaaaactgtagaaaatttgcagtaagaaacgttgttgtctgacgcataaatatgtttaaggctgacagagtaaatgattccctgcatctgacagcctgcttattcaaggagaaggcgtacctgacgtcatttcttacagttacgctttcaaccaacctttctctttcgcggcttccaattgtggtagcagatattgccacagctcagggtaagcctcagaaataaaatgaagcagattgaaaacctgttcaaagtggataccattctcaacccagctttggccatcgttatgcaggttcatgagtaccggcatgactctgtcgagcgttttggcaaaaattgcttcaggtgtttcagaatcttcgtattcattccacagcgccagaaaataatctctctgcgcttccggcagtaaaccgaaaatacgatgggcggccttaacttcatgttcatggattgcttcacgggcagctaaatcgaatgcgataacatctcctgcatcgatttcgacaatatcgtggatcagcgccatctgcacaacgtggccaatattcatttctcctacataaggcgcaaaactcatgacagcgagggcgaaatgccagctatgttcagccgaattctcatgacgctgattgttcagcaatttagttttgcgatgaaccgattttaacttatccagctccataataaatgcgatgatattagtaaatgggccgaaatcaacaggaggtacagctaatgacataaaaaacctcaaatattatttttcttcatctaatgaataaggaagcggttgaatggtaagagaacttccttcatcttcacggatacggaaaatactgtcagcagccatatcattgttcatgacaacttgcacccagattgaaccatcagcgagtctgaccgcagtcagaaccgagcccgttctgcgccatttatcacctagttgccactccagattgtctccggcgacgggaagagaagaagccgtaccagccagccagtacattgctcgtttattagcacctcggtatttggcacgagccaccatctcctgaccggtataacagcctttcttgaagctaatactaccctcaagagcctgaatattcatcgcttgtggaatgaactgggcgctgctggctgagtcaatgaccgggaagcctgcttcaatctccagtgccaaccactgctgactgtcgctcaattgcgcctgaaatttctctgctaacgtttccgctaactgggctgcggtagcctgatcggtgactaaaaggaaacgttctgtggggaaggcgaagtgaagaagggtagttgtttcgtgttgaataacggttgtttcggcaccgggcagggtgggaaacatttctgccagcgcgttcctgctttccgctccggcaacaccaagcaggatgctttcttcatctttagcaaaggtcactttggaaaacacagcatactttttcaattcagtcagctggggatccaatactgtgcgacgttcaatataggcaaaaccttcaccacggtgaaacagccgcaggttactccacatctttcctttggcatcacaatgtgcgctcaacatatgtttttggttgagcaaggcgacatctgatgtgacttggccttgcagatacttttccgcatctgcgcctgttacgcttatcatcccccaatcattaagggaaattaaagtcaggggaagtgctgctgaaggagatgggagttgtgcagaaatttgagcagaaaatagaatttggtcagccataacagctcctgccagtaaactatctgagaaataaggctaatggtaaaagagatggggcttaatgcaaaggagttattcttgttatttactgactggacgttaaaggtgatttgttgcgatgctcttcgcatattatcgatatatcttgattcaactgtcacgaatgatgaaaaacagtccagaatcgttgataattccctttgactgtgaaattttgcaaccgtgatcatttctgaaatgacaggtaacttgttaatctttcgcgacatcagcattgccgtctcaatggcacgaatgaaaataatcaagaggctttttaaacatggatattgacaataaagcgcgtattcactgggcatgtcgtcgtggaatgcgtgaactggatatttctatcatgccgttttttgaatatgaatatgactcattgaatgatgatgataagcggcttttcgttcgtttactggagtgtgcagatcctgatctctttaactggctcatgaatcatggtcgtccagaagatgatgagctgttccgcatggtgcaattgattcagagcagaaaccaagcccgtggccctgtggcactgtgaactgaaggtatcccgtcatagccgcctgttttcttcaggtgtgcatggcgtaattatgcttgccgcgtcattggctccgtggcctgccagtggtttttatctctggcttccactgtttgtcatcattatggtgagctgggtgtggagccaaaaaaacattagacggtgtcagggaaggctggtgctgttcagtggccagaaaatgcattggcaaaaagcggcgtggaaactcactaggccaccgtggttaagccgctatggtatggtgatcacacttcacgcctttgacaaaacagaaagtatccgccatcggtcgttaattcggttatgggtggcatcagacagtgtgccaccaaagatgtggcgtcatttgaaccagcttatgcgtcagtatcctgatatatagcgggattaaaacagcgcttccatttctgccaatatctgcatacaccattcgctcaaacgttcatcagtttgctcgaactggtttacatcatccagagccaggccgacaaattgtttgccatcttcggtcagtggtttagggctggtgaattcataaccttctgttggccaaaaaccaacaaactgcgcacccgcaggcagcaaatggtgatacagcattcccaacgaatccagaaaccattcactgtagtcgatctgatcccccatgccatacatggcaacgatttttcccgccagatccaatgatggaagctgatcccagatagccagccaatcttcctgtaattcaccgaaatcccaagtaggaatgccgagaatcaggacagaataaccttccatcaattggggatcacaatctttgacattatgcagttcgatcagatcttcgccgagtatatcgcgtattttttctgctaccatttctgtatagcatgtactggagccgtaaaagagaccaattttcatcattatttaccaggacatttcgaatatcaggggccgcattgtaacagaagaattgttttttcaggcataatagccgctcggaagtcgcagatataaaggagggcttgtgccaaaaaaacacgatttatcagaaaactattcctcgcaagataagtcatcggaacagaccccatcggctaatctccttatagagcaatttctggataccatctggctggaaaaggatctggctgaaaatacgctatcttcttatcggctggatttacaagccctagatagttggctggtatatggtggtcatgatttactttctgtggaatctattgaactacaattatttttggctgaacgggtagatagcggttataaagccagtagttcagcccgcttgctgagtgcaatgcggcggttgtttcagtatctttatcgtgaaaaaatgcgtttggatgatccaacagcacttttatctgcccctaaattgcctaaacgcttacccaaagatttaagcgaaaaacaagttgaggatttgcttaatgctcccttgattgaccaaccgattgaactgcgagataaagccatgtttgaagtgctttatgcctgcggattgcgggtgtctgagttggttgggctgacattatcggatgtgagcttacgtcagggtgtggttagggtagtgggtaagggaaacaaggaaagattggttcctttgggagaagaagcgctttactggttggaaaaatacctagagtatgggcgtccgtggttattaaatggttcggtatctgacgttttcttccccagcaaaaggggaacgcagatgacccgccagactttctggcatcggatcaaacattatgccgtactgtctggcattgataccgaacgcttatcaccccatgttttgcgtcatgcttttgcaacgcatttactcaaccatggtgcagacttacgcgttgtgcagatgctgctgggtcacagtgatctctccacgactcaaatttatactcatgtggcgactgaacgtcttaaagcgctgcatcaacaacatcatcctcgtggataactgtgaaaaaaatggaaataaaggaacaaaagatgaagaagctagcgttttgtttttccttattattgacggcctttgccagcaatgtatttgctaatgacagtgcggttaataactcattgtcaaaaatgggacttaaagccgaaagtatcacgccatcacaactggctggcgtgagcacggttttgacagatcagggtattattcatatctccaacgatggtaagtatttgttcaaagcccaggtttacgatattagtggcaaattaccaaagaatgtcaccaatcaggttctggtgaaaaaactggatgctctgaaaaatcaaatgattgtttacaaggcaccaaaagaaaaacatgtcgtgactgtttttactgatattacctgtggttattgccgcaagttgcatgaggaaatgaaagagtataacgatttgggtatcaccatccgttatttggcatttcctcgccatagtctgcaacatcaatcagccaaagatatgcaatccatctggtgcagtgcgacacctaataaagcgctggatgccgctttcaaaggggataacatttctccgatcaagagctgtaaaaatgatatagcgaaacaataccagttaggcttgcagtttggtgttcagggaacacctgcgattgtacttcaggatggcagcgtgtttggtggttttatgccgccaaaagatctgaaagaagctctggaacaaaatggtgaataattcgtcaatgactcaaattcagtgaagcaacccccagtgaatatagaaacacaactccgccgccgcccggtggcggatgacagtcatcttcccaatagtattcatccattattgcgtcgtttatacgctatgcggggtattcgtcaggctgatgaactggaacgtggggccaaagggctactcaattatcaatctctcaatggcattgaacaggctgtttccttgctgataacagcattgcacgaccattggcgtattgttattgtcggtgatttcgatacagatggggcaaccagtacagcattgtgtatccgtgctttgcgggcgatgggctatcgcaatcttgattatcttgtgccaaatcgttttgaagacggttatggcttaagtgttcaggttgttaatgaagtcgtcaaaaaaggcgctgatctgatcattactgtggacaatggcatctcttcccacgaaggggtggcagcggcacatcagcacagcatcaaagtgcttgtcaccgatcatcacttgcccggagagacactaccagccgcaggtgccattatcaaccctaacctgcatgattgtgctttcccctcgaaagcgctggctggtgtgggggtggcattttatctgatgtcggcactcagggcagaattacgtaaaacagcgtggtttgagcagcagggtattccgctgcccaatctggcggaactacttgatctggtggcactcggaaccgtggcagacgtggttcctcttgataccaataaccgtatttttgtgtatcaaggattgaaccgcattcgtgctggtcgctgttgcgtgggaattcgggcgctgcttgaaatttccaaacgggaatccaccaaactgactgccagtgatttggggttttcgcttgggccacgactgaacgcagccggacggctggatgatatgtccgttggcgtggctttattgttgacggatgatatggtgcaagctcgtcagatagcctgtgaacttgatggactgaaccaaacccgccgtgaaattgagcaggggatgaagcaggaagctttgcagatttgtgatcaattcgaacgtacccatactcagctaccttacggactagtcatttatcatccagagtggcatcagggcgtagtgggtattctggcctcgcgtattaaagaacgttttcaccgtccggttattgcctttgctccggcaggcgatggaacattaaaaggttcaggccgttcagtgaatggattgcatatgcgtgatgcgcttgagcgcctcgatactctgcatccgggcttgatattgaaatttggcggccatgctatggctgcgggcttgtcaattaagcaggataaatttgatctgtttcagcgccatttctctgcgttgatggccgattggctggatatcgcccagcttgagggagtggtctggagcgatggcgagctggccttaggggagttatcgctggaaattgcggaaattctgcgagaaggtggtccgtgggggcaggcatttgccgaaccgatatttgatggcaaattcaaactgctgcaacagcggattgttggcgaaaaacacctgaaagtcatgcttgagccattaaacggtgggccgatgttggatggcattgcgtttaatatcgatactcatcgctggccggataacagcgtcaaaacagtggaattagcctataaactggatatcaacgaatttcgcggtaatcgcgatgtccaacttttgatccagtacatctggcctgactgaattggcctgaatggtatgatcagctattaaaactttgccacatgaccaaaagtgattgtgtggcaaatctccagaaaggctataaaccgtttgacagatccgttagaatacgcagttcgaaaatatccatgtgaccactacgtataagacacaaaatatgtttgaaattaacccggtaaaaaaccacattcaggacttgtctgagcggacagaagttctgagggggtatctttgactatgatgccaagaaagaacgtttagaagaagtcaatgctgaactggaacagcctgatgtctggaatgaaccggagcgggcacaggcattaggtaaagagcgttcatcactggaaaacatcgtagaaacgattgaacagcttgatcagggtctggaagatgtgaacggcctgctggaactggctttagaagctgatgatgaagagactttcaatgaagccgtagctgagttggaacagttggaagaaaaactcggtcaacttgaattccgccgcatgttctcaggtcaatatgacagcgcaaactgctatctggatttacaggctggctctggtggtacagaagcacaggactgggccagtatgttgatgcgtatgtttttgcgctgggctgagtccaaaggtttcaaaactgaaattatcgaagagtctgatggtgacgttgctggtttgaaatctgcaaccattaaaatcatcggtgaatatgcttacggttggttgcgtacagaaactggtgtgcatcgtttggtacgtaaaagtccgtttgactcaggtggccgtcgtcatacctcattcagctctgcctttatttacccagaagtggatgatgacattgatatcgaaatcaacccggttgatttgcgtattgatgtataccgtgcttccggtgcaggtggtcagcacgtcaacaaaactgaatctgcggtgcgtatcacccacataccgactggccttgtaacccagtgccagaatgatcgttctcagcataaaaacaaagaccaggcgatgaaacagttgaaagccaaactgtatgaactggaaatgcagaagaagaatgctgataaacaggcgatggaagaaaacaaatcggatatcggttggggcagtcagatccgctcttacgttttggatgattcccgcattaaagatttgcgtactggcgttgaaactcgcaatacgcagtctgtgctggatggggatttggacaaattcattgaagctagcttaaaagccggcctatgaggaactaaaatgtcacaacagcagcagggagctgaacaggctcctgatttaaataatgaactgaaaactcgccgtgaaaaactggctgcactgcgcggcaacggtatcgcattcccaaatgattttcgtcgtgagaacatttctgaagatctgcatgcaaaatatgatgacaagactcaggaagaactggaagcgctaaacattgaagtgaccgtagcaggccgtatgatgactcgtcgtatcatgggcaaggcatcctttgcgaccttgcaggacatgggaggacgtattcaggtttacgtttcccgtgatgacctgccggaaggcatttataatgaacagttcaaaaaatgggatttgggtgacattttaggcgctcgcggtaaattgtttaaaaccaaaacgggtgaactttccattcactgtactgaactgcgcttgctgaccaaagcactgcgtccgctgccggataaattccacggcttggcggatcaggaaatgcgctaccgtcagcgttatctggatctgatctcgaatgacgaatcacgcaagacattccagatccgttcccgcatcatggctgcattgcgtaacttcatggtcaaaaaagacttcatggaagttgaaaccccaatgatgcaggcgatcccaggcggagcgagtgcgcgcccatttactacgcaccacaacgcgctggacatcgatatgtacctgcgcattgcaccggaactgtatctgaaacgtctggtagtgggtggttttgagcgcgttttcgaaatcaaccgtaacttccgtaacgaaggtatttctccgcgtcataacccagagttcaccatgatggaactctacatggcttatgcggattaccaggatctgatcgtactgaccgaagaactgttccgtactttgactcaggaagtgctgggtactacgttggtgaaatacggtgaacaagaattcgatttcggtaagcctttcaccaaaatgaccatgaaagaagcgatttgcaaatatcgcccagaaaccaatattgcggatctggatgacatggataaagctgtcgttatcgcgaagtctcttggtattgatattgaaaaaagctggggcttgggtcgtattcagtgcgaaatctttgaagaaaccgctgaaagccacctgattcaaccgactttcattactgaatacccagcagaagtttctccgctggcacgccgtaatgatgacaacccattcattacagaccgttttgaattcttcatcggtggccgtgaaattggtaacggcttctccgagctgaacgatgcagaagatcaggcagaacgttttgcagagcaagttcgtcataaagacgaaggtgacgacgaagcgatgttctacgatgatgactacgttactgcactggaacacggtttgccaccaacggcaggcttggggattggtatcgaccgtatggttatgttgttcacggatagccataccattcgtgacgtgatcctgttcccagcaatgcgcccgaataaataatcatttctgattaaaatcgacaaatgccctgtaaggttagccggacagggcgtttttttatactgataagacatactgaaacaactgactgaaatataaagaaaatccaacaataatcacttactgagattcaacagcaggtatatatttgacggcatcatttcgatgatgcgagtgtagttcaatggcagaacgagagcttcctagggcaaacgggtctaaattatactgacgtaaaccctcccgttagaaccttcagcatataaccattatcccatccagctttctggcgcttggttttcacacccaccttaacggttttctcatttttcagtaggttaagggctattttattcattaatgccatgttttcagcggcataaccacttctcagacgctggccgtcttcaccaaaactgacgtctaactgccagtgcagcttcgtttcaatgtgccaatgactgcgtatcgcgcacgcgataaagtccgccgacttatcacggtgactggtgataaagtaacgtctttcataacgcgctgattttccctgctcttcacgccaggactccacaaccgcaatgccgcccagcgtatgccactgagggtgccgagcccgcaaccaaccgatatcgttaaccagccacaaccgacgctcttcaatacggccatgatcgccctccgtgcactgggttttggcgtgagatattcccgtaaaatcgttcgccagctgggtttctaaaaagagtttgatatcatcatgaaactcgccctggttgctttttaacgccagcacataatcggcttggttctcgacaatctggtcagcgattttgtactggcagcccatcgcgtcaatcgtgatggtcgaaccgccaatatccagtagcgccaacaacttggggatcgcagtgatttcattcgatttgtccgagactttcacctgaccaaagcagagttgattcgcgactgaccaggcgctgaccagatggagagccggtgcgccattggctttgtcgagcgttccccgcaatgttttgccatccaacgcaataatgtcatcggagattttggctaagctgctcacccattgggtaaaagcgtccccaaattcttggggatcaagccgatttatcacatcgttaaaggtgtcgtgactggggatgccattgggaagatccagaaactgccgaaaccaatcttccttggatttaccgtattcttcaatcgcattgaaaccttcgcaaccgcagatcacggcacaaatcgaaatggttaaaatatcgatgagggcatactgtttagtgcggttgatacgcagatcagtgaggtgtccaaaggcgtgactaagcgtggttgcttgcatggcagtttctacggttatcatggtcagtatgcgaattataaatcacaaacatcgactcatgccctatgtttatgtgccgaatgcgtccagttaatcggattggtcaatttagacccgtttgccctgctttgttaaagtcgtcattttcagctgagttaaaaactgatgctttgtatatttgataaaaccagacccttgcgcggtatcgccataaaccagaagccattaccgttccagccttgtgccacgcgtacccagcaggacatgccatcatcggctttgtcgtaacggttccagtggaagtggtttttaatcgccccgtcttgtaatcatttttccaccgtgatcggttgtgtcgtttaataaaataatggttttgttagatatatttttatcctattttcaaaaaatcatcatatgctcttaattgatcaaaacatctaaaaaattataaataaaagattcaccatgtcagtttaaatgaattaaacaagatgataaaaactcactctctttatctgtgatatttttatcatttatttttaactcatagatccttaataaaaaaacatgatttcccaatggtatgaattttatctgcattgctgttatttccatgttatcaatttttctgaaaaggcattgacattaccatgttatattatcttatcttatataacaaatcgtctgtatactcaccccgattaaaatggagtaagtaaaatctaaaaattttcaattaattatttttagcatattcatatatgttattccttagaatgatattaacatacctatggatagtttattttttttcatacttaatttctccattcggatattcaatccatttattttctttatcttgaaatgattttctaattttagaaatatccaattttgggtcatgtattaaatagttagttattgtgataggcttcccgccttttaagggtaaaacatggccaaagttgacgtctattgccgttattgtcacaaatcagagcatgtcaaaggacatggaaaagggaatggcgggtatcctcgttatcgttgctatacctgctgtaaggtttttcagttggaatacacttatcaagcctgcaaacccggcgttaaagagcagattgtcgacatagcgatgaataatgggggaattcgtgacaccactcggatcctgagagtcgcaacagctactgttataaaaacgttaaaaaactcccccgaaacgtaacgacgctgcccttgatggaaatcacattcagcttatctgtgaaatagacgagcaagggtcatttgtggggaacaagaaaaatcaacgcgggctttggtatgcttgggaaccccgcctaaaacgaatagtggcccatgtttttggcgatcgcagtagaaaaacgttagacaagctactggctcttttatcgtcctttaatattcggttttactgcacagatgattatgttgtttatgataaccttcccgaggaagatcacctgactggaaagatgtttactcagcgtatagagagaacgaatttaactcagcgtactcgagtaaaaagactgaatagaaaaactatcagttattcaaaatccgaagaaatgcacgataaggtgatagggacttttattgagcgtgagtactatttttgatattcaatctaactatttaatacattaccgaaaaattatcttcttaggttgcgaatcaaaagaatactcccctttctttattttacctttcgatggaatgaatccatagtcaaggttgaaataaatttttaatcttgactgttaatgcaatgtgaggatttacctaatgtgttatgacaaaaaataagaataaataatataatgatattttatagattttaatccgtatggcggtaactttgaggttttttaaatacttaatcataatatgtatatagtgtggttaggcatatagaatgcaacttaatgattaaatgttaaataaaaacaactggttattcttattgcatttaaatgtttcgctgtgagttaatttaatttattttttcattgtttacattctgtttatagtttgtgggtattcatcatggcaatatacaaacgctatttatagggtcagggggttagaatgtataatttaaacacatgagtttaaattgacattgtaatattttttgcttatttattattacggtagctctatgaacgaaaggataataattcccattctcttaatattgtgcagtccttttcaggcagtggccttatctgaaaatattgacaatacttcatcatcatttatggatgaagatatgaaaacattgcaggaaagttcaagaaatatcagaggactacttgaaaaacgcagtcaccagagttttataaaccgtgcggagtcggttccagagaaaaaagaattacaggcatttacgggaattggacaatgtttacagattagtggtgtctaccttaaaggaataactttattatcattgaaagatctaacaacattaagtgctataccgactacctgcattactagtaataatataaataaattaacctccgaaattgaaaatatttatattaaaaaaggttatgtcaccgcacgtttgcaatttgttcctccttcccatgatcggaggttagggataaatgtgattgaaggttttattgagggtattgaagggggaacccgttggactaatagccaaacccttttccctcatttaacgaataagccattgaatctcaatcagcttgatcaaggattggatcaggcaaatcgcctacaatcaaataaaacaacaattgatatattgcccggaactaagaaaggtggttccattattaagctgcataaccagcattcttcaccgtggaaagtagttgttaaaactgataattatggacagaaaagtacgggagaatgggtcggtagattaaataccagttttgacagcccattaggactatcagatttcattagttttagtggaagcaatacgttggataaacacaacacgaaatatagtcgaagttatattctactttattcaattccctatggtgatgcaacaatcagtggattcagcggttattccgaatataccagaaatgctgatttacggatgagctcggtaaatttccacggaaattctcaacaatcaggggtacgctctgattgggtgttttatcgtgatcaaatgcagatagatacacttagtacgcaattaacttataaaaatagcaataactacatagaaggttcaaaaattgctattaacagcccgacattgagcgtgtttacattggggataagtcacctgaaaattactccaggaagattgattatccttgatgcaaatattgagaaaggaatgcggtggtttggtgcgcagacagccgctcctttccaagataagacgttcatcaaaggaagtttgtctgcgaaattacaacagcattttgcggtgtttaatttaccttttcaattcaatacccaattctatgctcagtacagtccaaatagcctaccgggtattgaatggttaaatattagcgataacagcgcattgcgtgggtttagtaaaaattctgtatccgctgataacggttggtatctgaggaacaccctttcccattcgattcccatacctaaaggttcagttacattaaatatcggtgcagatattggtcaggttcttggctataaaagcaaagttggttggcaaagtagcgctggattgagtacaggcattacattgaattaccaaaacctgttcgctgatgttgagctaagccaaggaaaaattctatcccatcaaaataagaatgctggtgagctgatacaattactgactcgtttttctttccgcttttaatctttgtatcgtgatttttgcgaaattttcatttttgctcgaaacacataatcatcattgaaaaccattgagggaattacatgagaaacaaaagatttaaattatctcctacagggaaatttgctgcatccatggccattattctggtttccagttcaacgagtttagctaatggtattaccccgggaggtgattctgcacatcaaccagggacgactaattcaaagacaggagcagcagtcgttaatattgtcgctccttcacaatcagggctgtcacataaccaatataatgattttaacgtcgagcaggcgggtgtggtttttaataactcattgtcggctggctcatcaaagctggcaggagaattatctgctaatagtaatttgggtggacatacagcaaaaattattctaaatgaagtgattagccgcaacccttctttaatattggggaaacaagaaatttttggtatggcggctgattatgtgctggcaaacccgaatggtattacttatcggaatggggaatttattaatacgaatcaagtatcactggttgttggtaatccactggttgaaaacggattgttaaatggatttagcaccttgggtaataaacattccttaaatattgggagtgcgggtcttgtaaaaagtaggattgtaaatcttattgctccaaaaatcgacaatcgtggtcaaattattgtgacgaaagatattaatattataacgggtaataaccgtgtctcaactgacggaaaagtattggattcacaacagacaagcgcgaatgcacttgatagttattatcttggtagtatgcaggctggacgtattcgattgctgaatactgccaaaggaaattgggttaatttgcaagggacaatggtcgctgatgacagtatcaatgtcgattccaatggaaggcttaacttggaaggtgccatagtgaaaggaaacgatgttaaatttaaagctgaacatattttatctcaaggaaatattaatgaatattcatcagagagtcatggtaaagataattatcataatattttcggtggtattgatgctcatcaaaaacaaactaaacagtcgctcactcggactaaattagagggtaagaacatcacccttatttccaatcaagacaatcaatttatggcaacggatattgagggagataatgttactctaagtggcgccaatctgaaattaaacggacaacaatttcatcagagtacacaagaaactgagaataaaagcaaatttttgtggaaacataaccgcagtaataccgatgaacagtaccagcagaaaggtaataccattaaggctcatggtaatattaaattaattgcgaacaaaggtgacttagaaatttctggcagtaagattggtgctggcgaaaaaatatcactgtctgccaaaaatgatgtgaaattagctaatctgatagaaacaaaaatcacgactgaaaaaaaatatcaacggaacgagacagcagcattaacaacaggagagagctttaaacgtaaagtcagacaaaaaaatatctccagtgagctgaacgcagatgatgatttaggcattaatgcgggcggaaatgttgaaattgttggtgcgaagattcatgctaaaaataatttgatactcaaagcagataagcaggtgaaaatttccacacaatctctcaataacattgatactgatgacaataaaacaaaaaattggggcggtgtcgctggcggaaaaaataaaaataatcactatgaagataaaacgcaggtatcttctgaaattactacggatggccgtgtactgttgacgggaaagacggggatcagtatcactggcagtaaggtgaaagggaaacagggtagttattctgatgcagttgatggagaattaactattgataatgcagtaaataataccaataaaaatattaatgaaagaacaggtgcgatttttaacattactaatcaatcaaataaaaataatagtatagaagagcgttcagtaaagagtgaagtaacttctgatgcggatctaaaattaattagcaataaagatatcaatgttattggtagtttagttaaaagtgcagatgaactgaatattaatacacttggaaatctcaatgtccattcttctgatgagaaaaagagtggttctaaagaaatcagttctctgaattggaaaaaccattttattaagcctgatgttaaagaaagtaagtcaattagcgttgaagtcggcctgaaaaataccagagatgattcgaaatacgatgttactgaacaaaaatcatcggaattgaatggtggaaatatcaagattaatgctgacaaagatgtttctatcactggctcagatattataacaaaaaaagggaatgctgatatcaaagctgataatatttctctgctttcggccgatgagtcaaaatctatggataaatcgcattcaatacacaattgggatgtggctgttacgcctgatagtaataaatttgaagctggctttaaagggactaaacaaagcgaaaacaattcccagagtcagaaaacaagtaaagtttcaacaacaaatattactggcgatctcaagctgaatgcgacaaaggaattaaagcaacaaggagctcggcataatgtagcaggtaattatgacgctaatgccggtagagttaataatctgtcaacagaaaatacagaatcaagttcctcaactaacacgcaggtgaagaataaatttggtatttcaattaaaggtaagaacgctcaaccttattctgatgttgatcttaaagctaacggcagtagacattcagaaaataccagcaagacaactaatgataccactttgatcaacgctaataaaatcaagctcgttgccgatggtgagatttatgatcaaggaacgcaatatcaggcgaccaaaaacgatatcgttttgcaggcagatagccacaagagtgatgcggtgttcaatcatgaggagagaaaaacttctgataccacgggtgatgctaatctggaggttggtgttaagcctgttattcaaagtacagaactcagtggtaagggaaaaggagacacactgtcgcattctcaatccagtactgatgcaattaccggttctcttaaggctaaaaacggcattacaattcggatgaaacatgatgctgcatatcagggaacatctatggatgcaggtactggtaaagttaacttagatgtggaaggaaatatcaacatcagtcaggccgataacatcaagcaagtcactgagaagtcttatagcggggatgtttcaactaaactggaagccaatataaaaccagtttcctctgatgccggtggcaagaatatcgcgaagactcaaagaacgactatggcaaaaatcagtgagatccatggaaaacagggcgtcagtttgaacgctggcaataatttgactctgcaaggtgccaacgttgatggagaagatataaatctaaccgcaaggcagggtaatgttgaactgacgtcagcccaagatacatccaataatgataatttgagtatggatgtcgattcttatgcgaatttgggaacaaataacagcactagcgataaatatggtgtaggtattaatccgaaattagcaaaaaaccatcttgatacgacgattaatcataatagccatattgcaggtaaaaaagttacgttggtcagtgataaggataccttcctcaaaggagcgaatatcacagcagataaagtaacgagtaataccagcggtaaactcaatattgaaacagttaaaaacacgacccatagccaaaatatcaaggtaagtatcggttctgactctccaaatgatgttcagagtactgatgtggcaaaagcagacgttaagaagaaggaaattttcagtaaaacggcttctgcttcacctgaaattaaaaacaagctgaaggccactttggatatggataccaaggaatcattagctgaacagtcaggtattgaagggactgaagaggttaatctgaatgttactggcaaaacctatttgacaggtgccaaaattgacagcaaaaaaggttccgttacgttgaatactcaagagatcgttaatcgggccagtacaacatatgacaagaacgaaaaagacagagttgaattaccgaactctcttacaaattttgttactgaaataccggaatatatttcagatattacatcagggaaaattccatttgtgaaaaaacagaatcatgagactaaaactcaggagcttcagagtacagtcaaagggcatgaattagattaaacatcttttaaaattaatctaaaaagtacagtgacacaataaatttgtgccactgtacttatttaatcgtatatctatgctttggtattataattaagtcatatttaatataaaaataaacagttatctcttaagatcctgtatgtgagtgaggaataacccatttaaatgatcgtgctatctctatttatagatcacatttgtcatagtactatcatttgcgattgaaaagtcgctcgctcacccatctgatttgcgatagcatttgcggccttttttacgattttctacgattagaggaggcaacatatgttcatcggttttgactatggcacatcaaattgctcagtagcgaggatgatgggtaatacaccacaactgcttgctattgagcatgacaatttctacatgccttcaacgttagcagctccgactcgtgaatcggtttctgaacacttatttcgtcaccggaatatccgacccggtaatcaagtgggggagcagcttcttcgcagcgcgatggctacaaatcgtgaggaaggtatcgagcttctttcggaagatatcgtcttcgggcaggcggcgttgaatcgatatatggaagatccgcaagaaatttactacgtgaaatcgccgaaatctttcttgggtgcaatggggttgagagagatacaaatcagcttctttgaggatttggtctgcgccatgatggccaatatcaaacagcgggcagaagctaatacacagcagatcattgaagaagtggtgattgggcggccgattaactttcatggtcgtggcggggataaatctaaccaacaggctgagaccattttgcttcatgctgcaaagcgtgctgggtttcgcaacattgaattccaatttgaacctgtggcagcaggtttggaatatgaagataccctgaccgaaaacaaaattgttctggtggtcgatattggcggcggaacaacagattgttccctcatccaaatggggccagactggaaagggaagtctgagcgcaacgagagtctattggcgcatagtgggcaacgtgtcggcggtaatgatttagatatcaatctgacctttaaacaattgatgcatccttttggattgggaagtcaatttgcatcaggcatcgagatgccactgacccaattttggaaccccattgccatcaacgatatacaagcgcaaaaagaattttactctcgtgagaacctgagagcgttaaaatctctgcatatggaagcacaggagccagagaaattagcgcgattattgaaggtatatcacgacacattgggatatagcctagtccgcagtgcagaagaagccaaaattgccctctcggatcaatctgagcatcgtgtgaaattgaatctactatcggaagtgattgagattgatcttcatcgtgatcaaatgattacagcgattgaatctaccaaagacaaaatggctaaattagtcagtgaagcggtggaacagggtggcactaagccagatgttatcttcatgaccggtggttcagcgagttccccgatccttcgccaggcggtggagcaagtattgccgggtatcccgctggtcagcggtaactactttggttcagtgactaccggtttagcgcgttgggcaaaagtttgtttcgctcaatgacgtgagtctgattatcgtagtttcgatacttatctttgatatttgtaaggctccggtgacctacgagtcgttgacaccctcgcactgggcgagggtttacagcggattttgctaaattccgtaaattcagcgagtaagccggataccagcgtacacactgagtaatgatatcaacaagataatgtaaacgtttgaaggtatttcgtattagagacatgagcagatcacagagtaaaagacagaatattacctgacctcaccttatgcgacagaactactcctcttccttaatttcaagcggttgtctttttttccggtaatggtaaaggaacactttctatgccgtatcgtcctgcaatttctgggcaggttactggttgacctatgttttctacaaatgttgtattcaaatcaataggtgcatcaattgccttaccatcttcaaaaaacatttgttccattcccggaggtgaaagcataatgagcattcgtgtattttcatctgtttcattacgaaaaccgcggatttgtccaacagaaaagtttaaaaaagctccttgttttccatacattgtttcagtctgcgtataaaaaaccatttcaccttctaatatgaagaaagcttcttcctctaatttatggaaatgaaatggagcccctttccctggttcaacaatgatttcaaccagactgtaacgactattggtttctgcaccagtagctacaactcgataaaaattaccttctgataacagccattgtccttcttttgcgcttttgtgagaaaatttgagcagctcattgtgcattttattccacctatattcaagcaatcaatataatgatttattatttgaatatatcagataattgcataatgcaaaaccatgaaaaaggtgaaagggttctgtcgtgttaacggtggcaggttagcaaaagtcgtgctgccaattttttaggggtcctgtggaagaacccacgaaaatgacgagtactggagcacttatcgttccaaaaatgttgtttcacatgctcttccagtatcaacgacatggcatcaacatcaagttccccgttactttttttgaaatgatagcggccagcaaacagcagtggctccaggctattggcgatatccggataaattcatcaataatctcctgagatacgctgctgataggtttttcttatattactcttaagttgatggtaagcctcggtacggttatgccatctcctacccgttgactctgttgcctgaggtgatgcgggtgctggcccgatgctgaaaccggaacacctctttctggtgcgagagcttgtcgacatgcgccgggggattgatgccctgacccaacatatcgaggggttaaacctgcgctgtgacctggatgactagggaggtttccacctctctgacaagtgcttactcatttatccttccgaccagatccgtgaggttttacatatccgaaccaaaccgcagaccttgggttgttcgcgtaatccaatttctgccatagcccagtaacaaagtgctcaatctgcgggctggacaacatggtcatgtggttaccgggtacatgcatagtgctgagttgagcaacgtgtgtattccacagggtttcgcgcgttttcgtttcatccacatctccctcttctgcgctaatcagatgaacaagaccctcatagcgggtacgaggtgtatagcaagtgttcagattggcttgcatgacgcgaacgacaccttgcagcagtgacattggtgttttggccgggaagagacctgcgtttaccagagcacgaagtaggtattgaagctgttcgtccggagccagattgtcaaaatcctgcttcgtaagcggcagcggtcgatccaatatcatattgtagatctcgatcagcttcattatcgtttcggtacggttgactggcttgggagtacgaccttgcggatcaggttcatcggtatcgacgaggataaggtcggagacttgttccccttctgcttgcagttgcaaggccatctcaaaggcgatccagccaccgaaagaatgacccagcaggtgatagggaccatggggttgcgtttgacggatgatctggatataggcacgagcggcaccttcgacactgacatagggaaaattgtgttcgtcagtcaggcccaggccgcgtgcctgtaaggcgtagactgggagttgctgtgggaacgacagcgccagtccgaggaggctagaggcgctggcacctgcaccgggcatgcaaaatagcggcggaaccgaccgagacccgctttggatgataacgcgtgggtcgtaggcaggagcgggcaataaatgctcggtgagtgaatccgctatctggttgagcgaagggggacgcatgatggagaaatgcgttccaccgatagcgtggagtgtcgaatcagtgccgacgatatcatgccaaccgtgccaaatttccccgttgagtgcttcatccgcggtatacaggtggatgggcaagggggattttggcgcgatatagtcttgacccagttgtgtaatgatctcggaggtgtataggcgaaggaggatatcctcgcgtgtgatactgatcggcagccattggtgttcaatacagcggtcaaggatttggttcacatcactgagatcgtgaagttcttctaatatctgctcatcattagcgccgatttgagcacgcagtgagtcaatgattatctcaattcgttttgcttccttgtctactggttggtcggtggtgatttctagcccatttatggagttataggaatcgatcataccgagaaattctaccgtctcgccgcagctcatgaattgttgcgccatttcataggcgatcaagccaccaattgaccatccggcgagacgataggggccttgtggctgaacgcgacgaatagcctgaatatggcaggccgcgagcgcctcaagcgacgctgggggatgctccagcgtgtggatgccaagggcttgcagcgcatagacgggaagctcaggcggcagtaaggctgccagtggcgaatagaccagtggatcgccggaagtctcgtgtaccaagaacaagggtggcaggcagcctgttgggtttagcggcacgggattcgcatcgaacggggacgttgattgggcaaaacgctcgccaatggctatcgccagatcacacaacgtcggatgagcgaacaaggtggtcagcggaaccgccatgtcttgctcgcgcatgcggttcagcaactgcacagcgagcagcgagtgaccgccaagctcaaaaaagtggtcgtgacgaccgacccgctccagtcctaataagtcttgccagatctgcgccaaggcggtttccgccgcaccgatcgggacctgatagccatgcgccaccacggcggacgaatcaggcgcggggagcacctgacggtcaagtttgccgttgggggtcagcgggaaggatttaagcgtcataaaggcgctgggcagcatgtactcggcgaggtgctgggcaagctgctggcgcagttcagcgggaaccagctcaacgccatccagaggccgtacataggcgaccagacgtttctggcccggctcgtcttcgcgtgccagcaccaccgcttcgcgcacgccgtgacattgcatcagttgcgcctcgatctcaccgagttctatacggaagccgcgcagtttgacctgaaagtcattgcggccgagatattcgatattgccgtcggggcgccagcggccgaggtcgccggtcttgtacatgcggccgtccggtgtcggggagaacggatcggcggggaagcgttcggcggtcagttcggggcggtttaggtagccacgggcaacgccggcaccagcgatatggatttcgccggccacaccaagggggacgggctgaccatgtgggttgagaatatagatctgggtgttggcgatcgggcggccgatatgactggcaaagccctccgcccggttcatccgtatccaggtcgaataagtcgttgtctcagagggaccatacagattgcacacatcctgtacgaatgagtgggcaaacaaatgctcaacaacgtgcggtttcaatgcttcaccggccaaattgaccgtccgggcggttgcgggaaccgcgttaacctcgatcaaatgcgcgatggccgacggcacggtgttgatcaggctgaccggctgttcggtggtgaccagcgacaacgcatcaggaacgagatgaaccgtgccgccagagacgagtggtgcaaagcattcgtacaccgctaaatcaaaattaagtgaagtagcgaaaagcgtatgtgccaattcctctgggctgaaagtccgctgcgcccagatgaggaaattcacggtattacggtgagcgatcgccacccctttgggtaagccagtagaaccggaagtgtagatcacatacgccagatggcgtgacgtcagccccagcgtctgcggctccggattgtcagttggttgtgctgccagagctggttcttgggcgtcgagcaccaccgtaggcacggggctgatcagtctgttaacccatgtcgtctgggtcagtaaggctacgggtgccgcgtcatcaagcatatacaccagtcgttcggtcggataagccggatcgagcggcacataggcgccgcccgctttgagaatagcgagcaggctcaccaccatctccgggctgcgttccagacaaattgccacccgatcatctgggcgcacccccagcgcaatcagatgatgagccagacgattggcgcggcggttcagttctccataactgagcgcatgctccccgcataccacggcggtggcatcgggatggtgcgctgcctgagcttcgaacagttggtggatcagcgcgttttgcgggaagtccgcctgagtcgcgttgaagtccaccagcaattgttggcgttcgtcttcgggcagcacgtccaagtccagcgcaggcgtatctggcgcttcaattagtatcgatatcaattgttctatcgctcttgtgagataggtatttattctatttggatcaatatcattgacggtttgagctgacagtacaaaatattcaccatcatcatcaatggacatttcaaatgggtaattggtgcgctcgcaactatccaaacttgccagaccaaacagatccagactaggtgtacgggtatttttgtcattaccgtgtcggaaatttagcagggcactgaacagggacatgccaccgagtccactgcaacgctgtgcaagcgacaatggagtctgttcgtaaagcagcaggctggcgcatgcgtcgttcgtcattttaacgagttcatctacgctgcttcctcttagcttcaatctcaagggcagggtattgatgaacatgcctaaagcgcgtgcactcccatcaactcccgacatgcggcctgacaaaacggtgccaaatacaatgtcatcgcgtccactcgtgcgtgcgacgacgagcgcccaagctgcgtggaacaaaattgcggggttagtaccaaagcggcgcgctgttttacgaatggcttgtgagagttcaacatcaagaaccttccgtgccgccgcgttatgctcgccattcccctgaacatcagctaggccaaaaggtgcggtgacctcatcgatatcggccagcaatgtccgaaagaaggcttccgcttcctgagttttaccttcctgacgtgcataggcgacaaagttacgataaggaacggatggcagtaaatccgcgccaagtcccatcaggaaagcggtcgtttctgcgagcaagcaccggagtgagaggttatcgtcgatgatgtgatgcaactggaacaagacgtataacttggacgaatatggttcggtggcgacttgcaaccgtatcagtggagcatgggacaaatccatgtgctgatgtgacagcgccatgcgtgcttgcatgctggcaaccacgtcactatcgtcatcgaatgtcaggacattgaccggcaatggtgcgtgtcgatgtaccacttgaacgggttgggataacccgatccagtggatagacgtacgcagaatatcgtgccggtcgatgacggcttgtaatgccgcaatgaatgcatcgagttttgtctggttttcgacgctcaacagcgacgatataacgtatggatctctgttcggctgaagcaggtgatggaacaggataccttcctgtagcggcgcgagcggatagatatcctgcacatgagtcactccgtcggggatcgcgtcagcgatggcatcaatctcagcctgggacagcgagaccagaggcagcatatcgggcgtgatggcggtacagccttcggggatgcgattgggcggcaccacgaaggtgtcggcgttcaggatagcttgcgccatatcgatgaggacaggtacggagaacacgctgcgaacgtcgagctgccaaccaaggccacgcagccgctcaatcagactgacgatcatcagcgaatgaccacccagttcaaagaaatggtcgtggcggccgacccgctccagtcccaataggttttgccagatttgcgctagggcggtttccacctcaccgaccggggcttcatagccgcgtgccaccacggcggacgagtcgggcgtggggagcgcctgacggtcaagtttgccattgggggtcagcgggaaagcgtcgagcgtcataaaggcgctgggcagcatgtactcggcaagatgttgggtaagctgctgacgcagttcggcgggaaccagttcaacgccgtcctgaggccgcaaataggcgaccagacgtttctgtcccggctcgtcttcgcgtgccagaacgacggcttcccgtacgccgggacattgcactaatcgggcttcgatctcaccgagttcgatacggaagccgcgcagtttgacctgaaagtcattgcggccgagatagtcgagatggccgtcggaacgccagcggccgaggtcgccggtcttgtacatacgggcgtccggatcagaagagaacggatcggcaaggaaacgttccgcggtcagttcaggacggttcaggtagccacgggcgacaccggcaccggcaatatagatttcgccagtgacaccgagaggaacgggttggccgtgggtgccgaggatatatgcccgcagatcaggtagcggctgaccgatcaaactgccacgtcccagggtgatgtcggattccgtgagttcacgataggtggcatgcacggtgatctcggtgatgccgtacatattgaccagacgggtctgtcgggtggggttacgggcgacccacggagcaagcgtatgcaactccagcgcttcacccccaaagataatgcagcgcagggaatgcggcgtggcatcctgggcagagatcaactgacgaaaagcactgggcgtttgattcagtacggtgacttgctcacggcacagcagcgcatagaacgcctgcggtgaacggagacagtcagccggtacgacgatcagccggccaccatgagacaaggcgccccagagttcccacaccgagaaatcgaaagcaaaggaatggaacagggtccacacatcattgccatcaaactggaaacgttcttgggtggcggctaacaggcgggtgacatgggcgtgctcgaccatcacccccttgggtaatccggtggagccggaggtgtagatgacatacgccagatggcgtgacgtcagccccagtgcctgtgtatccggattgtgatccgattgcgccatcagggatgcatcctgggcatcgagtacgattgtgggtatgggcgccgggacgtggctggtcagcgtgtcgacctgtgttgtctgggtcagcaaagctactggtgtcgcatcattgagcatatacgccagccgctcggccggataagtcggatcgagcggcacataggcaccaccggccttgaggatagcgagcaaaccgaccaccagctctaggctgcgttcgacacaaatcgccacccgatcgtccggacgcacgcccagcgcaatcaaacgatgggcgagacgattggcgcggcggttcagttcaccatagctgagcgtctggtcttcaaacaccacggcggtggcatcgggagaatgtgccgcctgagcctcgaaccgctgatggatcaaggtgttctgcgggaagtctacttggatagcattgaagccggtcagcaattgttgccgctccgatgccggcaagattggcacttgcaggatgggttgttgcgggtcgctgaccagcgccttgaccaagccgctgatagcggtggctagataagtggtcacgcgagccggatcgatactcgtcacagtctgggcagtcaggcggaaaccgaccccctgatcatccaccgagagggtaaccggatagttggttcgcccttcggttgcgacgatacgcatgcctgcccaaatcgtatcaaccgcgccggcttcgtcggcttgactatgacggtaattgagcaaggcactgaacagcggcatcggttgagccacaccactacagcgctgcgccagcgccaacggtgcctgttcgtgctctagcaacattgtgaggctgcggtaggtggcttgaaccgcttcctgtacgctgcaatcggccagagagatccgcaccggcagggtattgataaacatgcccagaactcggtcggcacccgcgcctccttgcaggcgacccagcagcacggagccaaagatcacatcgtcgcggccgctggtttgtgccagcacttgcccccaagcgacatggaacagcacgcttggactgactcccagacggcgggcctgagtgcggatagcctctgccaaattgggggtgagcaagagacgggcttcggtgacgggttcaccgtcgccctgcacgttgagcacaccaaatggcgctgtcggttcgtcgacatcagcgagttgggagcggaagtaggcctcatgcaccgtgtccgccacgctcagggtctgggcgataaagtcgcggtagggcagcgcggcgggcagtgcttgggcatgcccctgcaacagcagggcaatctcggtaaagataagtgccagcgtcatttggtcgctgaccagatgatggaaacgcagggccagcagccattcatcctgtgccggatcgtgggcaatgtcggcggcaaacagtggcgcgcggttcaggtcgagatggtgctggtgtggatcagtatgagcccgtaactgagccgggacgtcgtccgctgaggtcggggtaaagtgattgaccgacagtggcgcctgacgccaaaccacttgaaccggctgcaccagcccttgccagcaggcagcggtacgcaggatatcgtggcggtcgatgacttgttgcagcgcgaccagaaaagcatcgagatgttggcaggtgtcgaaggcaagcagagtctgcaacagataggcatcgccttgtgcctgtagcaggtgatggaacaggataccttcctgcaacggtgccaatggatagatatcctgtacattgctcgctccgccggggatcatgccgacgatagcatcaatctcagcctgagacagtgaaaccagggacagcatatcgggcgtgagggcagtgcagcctgcggggatgcggttgggcagcaccacgaaggcgtcggcagcgtcctgatgtatcaggatggtttgcgccagttcagcaaggacgggggtggcgaatacgctgcgaacgtcgagtcgccagccgaagccacgtagtcgctcgatcaaactgacgatcatcagcgaatgtccaccgagttcaaagaagtgatcgtgacggccgacccgttctagccccagcagggtttgccagatctgcgccaaggcgttttccacttcgcccactggtgcttcataatgacgtgttaccacagcggacgggtcaggcgcgggaagcgcctggcggtcaagtttgccgtttggggtgagtgggaaagcctccagcgtcataaaggcactgggcagcatatactcggcgagctgtcgggagagttgcagacgtagctcggccggaaccaattcaacgtcggtctgaggcagcagataggcgaccagacgcttgtgacccggctcgtcttcgcgcgccagcaccaccgcctcgcgcacgccgtggcattgtaccaatttagcctcgatctcgccgagttcgatacggaagccgcgcagtttaacctgaaagtcattgcggccgagatattcgatattgccgtcgggaagccagcggccgagatcgccggtcttgtacatacgggcatccggatcggcggagaacggatcggcaaggaaacgttcggcggtcagttcggggcggttcaggtagccgcgggcaacgccggcaccggcgatatggatttcgccagtgacgcccaagggaacgggttggccgtggggatcgaggatatagctttgggtattggcgatgggtctgccgatgaccgaaacatccggcacgctggccgtagcacagtattcataccaagtcgcatcgccattgatttcggatgaaccgtagaaattcagcagatggatccaagggtaatccgttattacctgccgagcgagctcaggcgcaagtcgttccccgctgcaaatcaacgtcctaatcgatttcaggtaatcgccactcccctgtatcaggagtttcagcagcgaaggcaccaccaccagatagttaacatcggcgtggcgtaagccttcgccgaaacgcgtaagatctttcacttcatggttatcgaaaacaaccagtttgccaccggccagtaatacgccaagtgtctcggtcactgaatcgacgaagctgatgctggttttcagcgccgccaccagtggtggtgtcacgatatcgcgaacgaaccacaacagccggttacacagggcttgatggctactcatcacccccttgggtaggccggtggagccggaagtgtagatcacatacgccagatggcatgatgtcagacccagcgtctgtgcttctgggttgtgggttagctgtgcttccataaacggttcttgggtatcgagtaccaccgtaggtatggcgctgttcagtgtgtcgacccatgccatctgggtgagtaagaccacgggtgccgcgtcatcaagcatatacgccaaccgctcggtcgggtaagccggatcgagcggcacataggcaccgcctgccttgaggatagcgagcaaaccgaccaccatctccagactgcgttcgacacaaattgctacccgatcgtccgggcgtacacccagattgatcagatgatgagccagccgattggcgcggcggttcagttcgtcatagttgagcgcctgatccccgcacaccacggcggtgtcggtggggtggtgtgccgcctgagcttcgaatagctggtggatcagggtgtcttgcgggaagtccgcctgggtggcgttgaagttcaccagcagctgttgtcgttccgaggtcggcagcatcggcaggccggcaatggcttgtgtcgtgtcagccgccatcgccgtcagcacatgagtcacatagccgaccatgcgctcaacggtcgcgtggtcgaacagatcggcggcatattctagatcaccgaccaaaccagcctcagtttcggtcagcgatagcatcaggtcaaagtgagcgccatagcgtacctgttcaacgggagcgagctgtaggccgggcaacgacaagtcttgggtcggagtgttatttaaggccagcatgacttggaagaccgggctgtagctcaggctacggtcgggctgcaaggcttctaccacttgctcgaagggaagatcctgatgggcataggcggcgagtgctcgctcacgaacctgcgtgagcaacccggccacattggtgacgtcacctggcgtgacgcgtaaggccagggtattgacaaagaagccgatcaaaccctcgaattcgcgatgctggcggttagcgaccggggtgccgacaacgatatcatcctgaccactgagccgggcaagaacgatgctccaggcggtcaatacggtcataaacaaggtggtgttatggcgctgtccaagtcccttaagtgatgccagcaacgtagtatcaaggtggagaggcacccggccgccggcatagctctgtacgggtgggcgtggccgatcggtggggagtgtcagcaaggccggggcgccttggagctgtctgctccagaagtcgtgctgttcggtgaggacggctccctgcaacccgttacgctgccagacggcatagtcggcgtactgaatgggcagtggcggcagcggatcgctgtggccgtcaagggcggcacggtagagggcaacaagttcgtgtaccagcacaccgatggaccagccgtcagcgatgatgtgatgctgggtgagcagcaatacatgctcttcgtccgtcaattgcagcagctgaccgcggatcagaggacctcggataaagtcgaatggcgtctgcgcttcaagggcggcgagctcggtgacacggttgttacgcactgctgagtctaacgggcgcagatcctggcaggatagcgcaaagccgatatcggcgggatcaatgtgctggcagggttggccttcgactaggacaaagcgggtgcgcaggctctcttgccgggcaaccaggtgatcgagtgcggtggtcagcgcgtggcggttgagtgagccagtaagacgcagcgctgccggaatatggtaggcctggctggcagcgggatcgagctgcccaaggaaccatagccgttgctgggcgaaggatagcggaagcaactggctgcggtcggccacagggatgatgacctgagtcgtcacggaagcgccggtgagtgcgtgggccagatccgtcaggatgggctgggcaaagagttgttgtagcggcaattcccgcgccagatcttggcgtacacgcgcggcgagttggacggcaagcagagaatggccgccgagttcaaagaagtggtcatgacggccgacctgctccagccccagcaagtcttgccagatctgggccagagcggtttctattcttccctgtggcggctcatagccgcgtatcaccacggcagacgagtcggggacggggagtgcctgacggtcgagtttaccattgggggtcagcgggaaggacttaagcgtcataaaagcgctgggcaacatgtattcggcgaggtgttgagaaagttgctgacgcagttcggccggaaccagttcgacaccggtttggggcagcagataggcgaccaggcgcttgtggcccggctcgtcttcgcgggtcagaaccaccgcttcgcgcaccccgtgacattgtacaagtcgagcctctacctcaccgggctcaatacggaagccacgcagtttaacctgatagtcattgcggccgagatagtcgatgttgccatcgaaaagccagcggccgaggtcgccggttttatacatgcgcgcgtctggatcggcggagaacggatcggaaacgaagcgctcggcggtcagttcgggacggttcaggtagccacgggcgacgccggcaccggcaatatagatttcgccggccacaccgaggggggcgggctggttgtggcaatcaaggatatagatccgggtattggcgatcggacggccgatgggaatagcgtgagcaacatcgacgggtgatgcaatgtgataggttgtggcaaacgtcgtggtttctgtcggaccatagccgttgatgagatgtgccggctgagactcagccaattgtgcacgttgaatcttcctggggtcgagtacatcgccgccgatgagcaggtagcgtagttgtccgaacagggggccgagatcgctgagatattcgttgaacaagccggccgttagccagagggcggtgacttgccctttgatcagcgaatcgcggaaacgtaccggatcgagcagcactgagggtgaaaccacatataaacgcccaccattgagcagagcagaccagatttcccacgttgaagcatcaaaggcaatattggcacaatgggcaatacagtcttcttctccaatatcggcaaaaccattattgatgatgagacgaaggacattccggtgttcgaccatgacgcctttgggcaacccggtggagcctgaagtgtagattacatatgccagatggcgtgacgtcagccctagtgtctgcggctccgggttgtggatgggttgtgctgccacagtcggttcctgagcatcgagtactattataggtacaggcgtagtcacggggctgaccagcgtgtcaacccatgccgtctgtgtgagcaagaccacgggtgccgcgtcatcaagcatataggccaaccgctcggccggataagccggatcgagcggcacataagcgccgcctgccttaagaatagcgagtaagccgactaccagctccaaactgcgttccagacaaatcgccacccgatcgtccggccgtacacccagcgcgatcagatgatgagccagttggttggcgcggcagttcagttcgccatagctcagtacctgatcctcaaacaccacagcggtggcatcgggtttgtatgccacctgagactcgaacagttggtggatcagagcgttctgtgggaagtgcgcctgggtggcgttgaagttcaccagcagttgttgccgctctgctggtggcaggatcggcacatctcgaatcaactgttgcggattgtgggtcaaagcatcgaccaagccactgatcgccgtagccagatacgcggtgacgcggatcgggtcgatccccgtcacagtctgagcggtcagatggaaaccagttcccagatcatcgactgacagggtgatcggatagttggttcgctcctctgttgttaaaatgcgcatacctgcccaagtcgtctcagctgtatctgccttgccggcctgattatgacggtaattgagcaaggtactgaacagcggtatcgactgcgccatgccgctacagcgttgagccagcgccaacggtgcttgctcgtgctccaatagcatggtcagaccgcggtaggtcgcctgtactacggcttgcacgctgtggtcggccagagagacccgcactggcagagtattgataaacatacccagtattcggtcagcacctgcgcccccttgcagacgacccagcagcacggagccaaagaccacatcatcgcggccgctggtctgcgccagtacctgagcccaggccacatggaacagtacgcccggactgacccccagacggcgagcctgagcgcggatagcctccgccaaagcaggtataagtggaagacgggcttcggtgacgagttcgccgtcagcctgcactttgagtataccgaacggcaccgtcggttcgtcgacgtcggcgagttgatcgcggaagtaagcctcatgaactgcggccggtatgctcagggtctgggcaataaaattgcggtagggcagcactgtgggcagcctgtcggtatgtccctgcaatatcagggcaatctcagcgaaaacgagctccagcgtcatatgatcgctgaccagatggtggaaacgcagagccagcagccattcatcctgtgccggatcgtgggtgatatcggcggcaaacagcggcgcacggctcaggtcgagacggtgacggcgtggatcagtgtgagcccgtagccgagccggaacatcgtccgccgtgtctggggtaaagtcattgatacacaggggtgcctgacgccagaccacctgaaccggctgcaccaatccctgccaacaggcggcggtacgcaggatatcgtggcggtcgatgacctgttgcagggcgtccagaaaagtatgaagacgctcgcggctgtcaaaggcgagcaggctctgtagtagatagtcatcaccttgtgtctgtagcaggtgatggaacaggataccctcctgcaacggcgccagcggatagatatcctgcacattggtcgccccaccggggatcacatcggtgatggcatcaatctcagcctgagacagcgtgaccaggggtagcatgtcgggagtaagggcggtacagccttcggggatgcgattgggcggcaccacgaaagcgtcggtgtcactctggatggtttgtaccatttcggcgaggacgggcgcggcgaacacgctgcgaacctcaagccgccaaccaaggccgcgcagctcttcgatcaggctgacgatcatcagcgaatgaccacccagttcaaagaaatggtcgtggcggccgatccgttccagtcccaacaggttttgccagatttgtgccagggcggtctccacctcaccgaccggggcttcatagccgcgcaccactacggcggacgcgccggggacaggaagcgcctgacggtcgagtttgccgttgggggtgagcgggaaagcgtcgagcgtcacaaaggcactgggtagcatatactcggcaaggtgctgggcgagttgttgacgcagttcagccggcaccagttcagcgccggtctggggcagcagataagcgactagacgcttgtggcccggttcgtcttcgcgtgccagaacgacggcttcccgtacgccggggcactgcactaatcgggactcaatctcgccgagctcaattcggaagccgcgtagtttgacttgaaagtcattgcggccgagatattcgagatggccgtcggaacgccagcggccgaggtcgccggtcttgtacatacgggcgtccggatcgaaggagaacggatcggcaaggaagcgctccgcggtcagttcaggacggttcaggtagccacgggcgacgccggcaccggcgatatggatttcgccagtgacaccgagaggaacaagctgaccgtgggcatcaaggatatatgcccgcaaatcgggtagcggctggccgatcaagctgccgcgtcccagggtgatgtcggattccgtgagttcacgataggtggcatgcacggtgatctcggtgatgccgtacatattgaccagacgggtctgtcgggtggggttacgggtgacccacggggcaagtgtatgcaactccaacgcttcccccccaaagatgatgcagcgcagggaatgcggcgtggcatcctgagcagaaatcaactgacgaaaagcactgggcgtttgattcagtacggtgacttgctcacggcacagcagcgcatagaacgcctgcggtgaatggagacagtcagtcggtacgacgatcagccggccgccatgagacaaggcaccccaaagttcccacaccgagaaatcgaaagcaaaggaatggaatagggtccacacatcattgccatcaaactggaaacgttcttgggtggcggctaacaggcgggtgacatgggcgtgctcgaccatcacccccttgggtagcccggtggagccggaggtgtagatgacatatgccagatggcgtgacgtcagccccagcgcttgtgtgtccggattatgatccggttgtgccatcagggacgcctcttgggcatcgagtacgattgtgggtacggacgtagatactgggctggtcagtgtgtcaacccacgtcgtctgggtcagcaataccacaggtgcggcatcattgagcatatgcgccagccgttcggccggataagtcggatcgagcggcacataggcgccaccggccttgaggatcgcgagcaaaccgatcaccagttccgggctgcgttcgacacaaattgccacccgatcatccggacgcacgcccagcgcaatcagatgatgggcgagacgattggcgcggcggttgagttcaccatagctgagcgtctgatcctcaaacaccacggcggtggcatcgggagaatgtgccgcctgagcctcgaaccgctgatggatcaaggtgttctgcgggaagtctacttggatggcattgaagccggtcagcaattgttgccgctccgatgccggcagtatcggcagatccgcaatagtttgtgtcgcatcggccgccatcgccttcagcacattttccagatagccgaccatgcgttcaacggttgcggagccgaacaggtcggcggcatattccagatcaccgaccagacccgcctcggtttcggtcagcgataacgtcaggtcaaagtgggcgctatggcgcacttgttcaagtggcgtgagctgtaggccgggcaatgtcagatcttgggctggggtgttgtttaaggtcagcatcacctgaaagaccgggctgtagctcaggctgcgatcgggctgcaaggcttccaccacctgctcgaagggcagatcctgatgggcataggcggcgagcgcacgctcacgaacctgcgcgagcagatcggccacacgcggggtattacccggcgtgacgcgcagggccagggtattgacaaagaagccgatcaggttctcaagctcacggtgtggacgattggcgactggggtaccgataacaatatcatcctgaccactgagccgggagaggacgatgctccagccggtcagtacggtcataaacaaggtggtgttgtggcgctgtcctagccccttaagcgatgtcagcaaggtcgcatcaagctggaagggaacccgatcgccggcataggtttgtactgacgggcgcggccgatcggtggggagttccaaaaaggtcggggcgttctggagctgggcgcaccagaaatcgcgctgctcagtaagaacggttccttgcagccagtcgcgttgccagaccgcataatcggcgtactgaatgggcagcggcggcaacagatcgctatgaccgccgaggatagcgcggtagagggcgcccagttcgtgcaccagcacactgatggaccagccgtcagccatgatgtgatgctgggtgagcagtaacacatgctcttcgtctgccagttgcagcagttgaccgcggatcagcgggccttgggtaaagtcgaagggcgtctgcgcttcgagggtggcgagttcggcgacacgatgagtgtgcgccggcggttccagtgggcgcaggtcctgataggacagggtaaagccgatatcggcgggatcgatgtgctggcagggttgtccttcgatcaggataaagcgggtgcgcaggctctcctgccgggcaaccaggcgatcgagtgcggtgatcagggcgtggcggtcaagctggccggtgagacgcagcgctaccgggatatggtaggccaggctggcggcgggatcaagctgacccaggaaccacagccgttgctgggcgaaagataatggtagcggtcggctgtgatcggcggcggggatagcgacctgagtggttgccgacgtgccggtcagcgtctgggcgagttctgccagcaggggttgggcgaaaatctgttgtagtggcaactcccgcgccagatcctgacgcacgcgtgccacaagctggacggcaagcaacgaatgaccgccgagttcaaagaagtggtcgtgacggccgacccgttccagcctcagcaggtcttgccagatctgagccagtgtgatttctactttaccgaccggggtttcatagccgcgtgccactaccgccgacggatcaggggcggggagcgcctgacgatcgagtttgccgttgggggtgagcgggaaggcgtcgagcgtcataaaagcactgggcagcatgtactcggcaaggtgttgagagagctgctgacgcagttcggctggcaccagcttaacatcagactggggcagcagataggcgaccaggcgcttgtggcccggctcgtcttcgcgggtcagcaccacagcttcgcgtacaccggggcattgcaccaattgagcttcaatttcaccgagctcgatacggaagccgcgcaatttgacttgaaagtcattgcggccgagatattcgatgttgccgtcggggcgccagcggccgagatcgccggtcttgtacatacgggcgcccggatctgcagaaaagggatcggtaagaaaacgttcggcagtcagttcggggcggttcaggtagccgcgggcaacacccgcgccggcgatatgaatttcgccggccacgccgagaggaacaggctgcccttgtgtatccaggatataaatccgggtgttggcgatcggctggccgatgggcggtgctccttcttcctggctatcgcacagataaatagctgcgcagaccgtactttcagtcggtccataggcattgaccatacgccgaccttcagcccagcgtttgaccagcgcgggtgagcaggtctcaccgcctacgatcagagtttgcagtgtcacaggaactgtatccagagccgccagcgcggtgggtgacagcagcacatgggtaatggcatgggtctccagcgtattcagcagggcagcaccaggcaggagatggatacgctgggcaagatggaggcaagcgcctgccagcagtgccatgccgcattcccagataccggcgtcaaagctgtttgaggcaaattgcaggatacggctgtcgggtttgatcgccagagtgtcctgctgagtggcgatcaggctgctcagaccgcgatgctcgatcattacccccttgggtagtccggtggagccggaggtgtagatgacatacgccagatggcgtgatgtcagacccagtgcctgcgtatccgggttatgagcagattgcgctgccatagccgattcttgggcatcgagtacgattgtgggtacgggcgtagagatggggttgatcagcgtgttagccagtgtcgcttgggtgagtaaaactaccggtgccgcgtcatcgagcatataggccaaccgctcggccggataggccggatcgagtggcacataggcgccgcctgccttgaggatagcgagtaggccgaccaccagctccgggctgcgttcgacacaaatcgccacccgatcgtccggacgcacgcccagcgcgatcagatgatgggccagacgattggcgcggcggtttagttcgccatagctgagtgtctgatcctcgtacactacggcagtggcgccggggttgtgtgctacctgagcctcgaacagctggtggatcagggcgtcctgcgggaagtccgcctgagtcgcgttgaaatccatcaatagttgttgccgctcggagggtggcaggatcggtacatcctgaatcaatcgttgcgggtcgcgagccagggcatcgaccagaccgctgatggcagtaaccagataggcggttacgcgagccggatcgatcccgactacggcctgagcagtcaggtggaaaccggcgcccagatcatccaccgacagggtgagcggatagttgctctgttcctcaacggcgaccacgcgtataccggtccaaatcgtgttaaccgcgtctgcctcgctggtttggctatgacggtaattaagcagggcactgaacagtggcatcgactgcggcacgccactacagcgttgtgccagcgccaacggtgcctgctcgtgctccagcagcgtcatcaaatcgcggtaggtggcctgcaccacttcctgcacactgcggccggccagagagactcgtactggcagggtattgataaacatccccagtatacgatcagcgccagcgacccctaacaggcgacccagcagtacagagccgaagacgacatcattatggccgctggtttgtgccagcacctgagcccaggcgacatggaacagtacacctgggctgacccccagacggcgagcctgggtacggatggcctccgccagagcgggagtgagcgggagacgggcttcggtgacaggctcgttatcgccctgcaccttgagcacgccgaacggtgccgtcggtgtgttgacgtcggcaagctgggcgcggaaataggcctcatgcactgcggccggcacattcagggtctgggcgataaagtcgcggtagggcagcgctgtggggagtgtctcggcctgcccctgtaacacctgagcaatctcagcgaaaatcagctccagcgtcatatggtcgctgaccagatggtggaaacgcagagcgagcagccattcatcctgtgccggatcatgggcgatgtcgccagcgaacagcggcgcacggctcaggtcgagacggtgttggcgtggattggtgtgagccaataactgagccgggacatcgtccgctgtggctggagtaaagcgattgacacacagcggtgcctgacgccagaccacctgaaccggctgcgccaatccctgccagtaggcggcggtacgcaggatatcgtggcggtcgataacttgttgcagcgcggccaggaaagtatcaagacgctcgcggctgtcaaaggcgagcaggctctgcaacagataggcatcgccttgttcctgtagcagatgatggaacaggataccctcctgtaacggtgccagcggatagatatcctgcacattgcttgccccgccgggaatggtgtcgacgatagcatcaatttcagcctgggacagtgagaccaagggcagcatatcgggggtgagggcggtgcagccttcggggatacagttaggctgcacgacgaaggcgttggtgtcaccctgaatagcctgcgccatctcagtgagaacgggggtggcgaacacgctgcggacgtcgagccgccaaccaaggccatgcagccgttcgatcagattgacgatcatcagcgagtggccgccgagttcaaagaagtggtcgtgacggccgacttgctccagccgcaacagatcttgccagatttgtgccagagcgatttccacctcaccgaccggggtttcatagccgcgagcgaccacagcagacaggccgggggcgggaagcgcctgacggtcgagtttgccgttgggggtgagcgggaaagcgtcgagcgtcataaaggcactgggcagcatatactcggcgaggcgctgggcaagctgttgacgcagttccgctggaaccagctcaacgccgtccagaggtcgcagataggcgaccagacgtttctggcccggctcgtcttcacgcgctagcaccaccgcttcgcgcacaccgcgacattgcatcagttgggtctctatctcgccaagctcaatgcggaagccgcgcaatttaacctgaaagtcattgcggccgagatagtcgatattgccgtcgggatgccagcggccgaggtcgccggtcttatacatacgagcatccggatcggaggagaacggatcggcaaggaaacgctcggccgtcagttcggggcggttcaggtaaccgcgggcaacgccggcaccggcgatatggatttcgccggtcacaccgagcggaacgggctgaccgtaggcatcgagaatatagatccgggtattggcgatcgggcggccgatatgactggcaaagccctccgcccggttcatccgtatccaggttgaataagtcgtcgcctcagaaggaccatacagattgcatacatcctgtacggatgtatcggcaaacaaatgctcaatgacgtggggttttaatgcttcaccggccaaattgaccgtccgggcggtcatgggaaccgccttggcttcaatcaagtgcgcgatggctgacggtacggtattgatcaggctgaccggctgtgcggtggtcatcagcgacagcgcatctgggacgaggtgaaccgtaccgccagcgatcaacggcacaaagcattcgtacaccgctaaatcaaaattaagcgaggtggcaaaaagagtatgtgccaattcctccgggctgaaagtccgttgcgcccaggtgaggaaattcaccgtattgcggtgggcgatcgccactcccttgggctggccggtcgagcctgaggtataaatgacatacgccagatggcgtgacgtcagccccagcgcctgtggctccggattgtaggccgattgtgtcgtcatagacgattctggggcgtcgagcaccaccgtggggatggtgctggacagcatgtcgatccacgccgtctgggtgagcaaagctaccggtgctgcgtcatcgagcatatacgccagccgctcggccggataagtcggatcgagcggtacataggcaccgcctgccttaaggatagcgagcaggctcaccaccatctccgggctgcgttccagacaaatcgccacccgatcgtccggacgtacgcctagcgcgagcagatagtgggccagacgattggcgcggtggttcagttcgtcatagctgagtgtttgctccccacataccacggccgttgcaccgggactgtgtgccgcctgagcctcgaacagttgatggatcagggcatcctgcgggaagtctgcctgggtggcgttgaagtccaccagtagttgttgtcgctccgagaatggcagcattggcaggctcgcaatggcttgtgttgcatcagctgccattgccgccagcacattttccaaatagccgaccatgcgctcaacggtcgcggggtcgaacagatccgcggcatattccaaatcaccgatcagaccggcttcggtttcggtcagcgataacgttaggtcgaagtgggcaccatagcgtatttgttcgactggcgtgagctgcaaaccgggcaatgtcaggttttgggacggggtgttgtttaaggtcagcatcacctggaagaccgggctgtagctcaggctacggtcgggctgcaacgcttccaccacctgctcgaagggcagatcctgatgggcataggcggcaagtgcccgttcacgaacctgcgcgagcaggtcggtcacacgggaggtatcacccggggtgacgcgcagagccagggtattaacgaagaagccgatctggttctcaagctcatggcgcgggcggttagcgaccggagtgccgatgacaatgtcatcctgaccactgagccgggtgaggacgatgctccaggcggtcagcacggtcataaacagggtggtgttatggcgttgtccgagttccttaagcgacgctagcaaggtcgcatcgagctggaagggaacttggccgccggcatagcgttgcaccgggggacgtggccggtcggtggggagtgccagcaaagccggggcatcctggagctgactgcaccagaagtcacgttgttccgtgaggatatccccctgtagccagtcgcgttgccagacggcatagtcggcgtactgaatgggcagcggtggcaagggatcgcagtggccatcaagggcggcgcggtagagggtgcccagttcgtgcaccagcacaccgatagaccagccgtcagcgatgatgtggtgctgggtgagcagtaacacatgcgcttcgtctgtcagttgcagcagttggccgcggatcagcgggccttgggtaaagtcgaaaggtgtctgcgcctcaaggtcggcaagctcggcgatacggttgctgtgcattgccgggtctagcgaacgcagatcctggcaggacaggacaaagccgatatcagcgggatcgatgtgctggcagggttgaccctcgaccaatacgaagcgggtgcgcaggctttcgtgccgggcgattaggtgatcgagtgcggtggtcagggcgtggcggtcaagctggccggtgagacgcagcgctaccgggatatggtaggccaggctggcggcgggatcgagctgagcaaggaaccacagtcgttgctgggcgaaagacaatggcagaggaagattccgatcaacctgcttgatggatggccgctgctgttgctgagtttgcaattgttgtttgattttcttttttagcacagcacgtttcagattatcgaggttcatgtcattccttatcattgattactgtctccgcctaaaattgccatcagttcttctgttgacattaaatcaagtgagttttgtatcgattcaatatcgttttcccctatcgcatccatttgtgctgaaaaaatgatgttggcctgttctgccaatttgggggaaagaaacaacgaggcgatagggatatcgaccagaaattcggtttgtatgcgcgttgtcaattgcacggccatcagcgagtgaccgccgagttcaaagaagtggtcgtgacggccgactcgttccagccccagcaggtcttgccagatccgagccagagtggtttcctcctcaccgagcggggcttcgtagccactggctaccacggcggacgcgtcgggggcggggagcgcctgacggttaagtttgccgttgggggtgagcgggaaagcgtcgagcaccataaaggcgctgggcagcatatactcggcaaggtgttgggcgagctgctgacgcagttcggccggcaccagttcaacgccgtccagaggccgtacataggcgaccagacgcttgtgatccggttcgtcttcgcgtaccagaatcactgcctcacgtaccccgtgacattgcaccaatcgggcttcgatctcgccgagttcaatgcggaagccacgcagtttgacctgaaagtcattgcggccgagatattcgatattgccgtcgggaagccagcggccgaggtcgccggttttgtacatgcgggcgcccggatcggagacaaagggatcggtgaggaaacattcggcagtcagttcggggcggttcaggtaaccgcgggcgacgccggcaccagcaatatgaatttcgccggtgacaccgagaggaaccggctggccttgggtatccaggatataaatccgggtgttggcaatcgggtggccgatagggatttttctatattcgctttcagtcagcgggatttcataagctgtagcgaaggtggtggtttccgttggcccatacacatgcagcagatgctctggcgggtaatcggttctaagactgatcgcaggacggatatcggcctgttcaccgccgaaaaggacataacgtaaacccgacaatgatgaggcgatcaaactcgcgtattgattgaacaacgcagttgtgaggaagagcgcactgacgccttccgatgttaatcgctgcccaaaatagtcgggttgtaataaggtcttttccgggatcaacaggatacgtgcgccatgcactaaccccgcccacacctcccaggtggccgcatcaaatgagacgttggcgcaatgggcaatacagtcatcggggccaatatcggcaaagccattattgataatcaggcgcaggacattgcggtgctcgaccatcacccccttgggtaatccggtggagccggaggtgtagatgacatacgccagatggcgtgacgtcagccccagtgcctgagcgtccgggttgtagtctggctgagccgccagagatgattcttgggtgtctagtactaccgctggcccggggctgattagcttgtcgacccatgctgtttgggtcagcaaggccaccggtgccgcgtcatcgagcatataagctaaccgctcgactggataggtcggatcgagcggcacataggcaccgcccgccttgaggatagcgagtaagccgactaccatctccgggctgcgttccagacaaattgccacccgatcatccggccgtacgcccagggcgatcagatgatgagccagacgattggcgcggcggttcagttcgtcatagctcatcgtctggtcttcgtacactacggctgttgtggctggctggatcgctgcctgagcctcgaacagctggtggatcagggcgtcctgcgggaagtccgtctcggtggcgttgaagtccaccagcagttgttgccgctctgccagtggcaggagcggcacatccagaatcaactgttgcgggtcgtgagccagggcatcaaccagaccgcggatagcattaaccagatagacggtgacacgagccggatcgatcccggccacggcctgagcggtcagatagaaatcggctcccagatcatccaccgacagggtgagcggatagttggttcgttcctttgtcgcgatgatgcgcatgcctgcccaagttgtgtcaaccgcctctgcttcgccaatttggctgtggcggtaattgagcagggcactgaacagcggcatcggctgggccacgccactacagcgctgtgccagtgttaacggagcctgttcatgttccagcagcgtcattaaattgtggtaggtggcctgcaccacttcctgcacgttgcgactggccagagagactcgtatcggcagggtattgatgaacatgcccagtactcggtcggcgccagcgcttccttgcaggcgacccagcagcacggaaccaaagatcacgtcgtcgcggccgctggtttgtgccagcacctgagcccaggccacatggaacagcacactcggactgacccccagacgacgggcttgggtgcggacggctcccgccaggtcgggggtgagcgggagacgggcttcggcgatggattcattatcgtccggtatcgtgagcataccgaacggtgcggtgggggcgtcgacatcggcgagttgagcgctaaagtaggtttcgtgcactgcggccggcacattcagggtctgggcgataaagtcgcggtaaggcagtgctgtggggagtgtctcggcctgcccctgtagtatttgggcaatctcggcaaagataagctccagcgtcatatggtcgctgaccagatggtggaaacgcagaaccagtagccattcattctgagccggatcgtaggcgatgtcggcggcgaacagcggtgcacggttcaggtcgagacgatgccggcgcggatcagtatgagccaataactgagccggaacgtcgtccgccgtggctggcgtaaagagattgacatacagcggtgcctgacgccagaccacctgaaccggctgcaataatccctgccagcaggcggcggtgcgcaggatatcgtgacggtcgatgacctgttgcagggcggccaggaaagtatcgagacgttcgcggctgtcgaaggcaagcaggctctgcaatagataagtatcgccttgtgcctgcatcaggtgatggaacaggataccttcctgcaacggcgccagcggatagatatcctgcacattactcgctccgccggggatggcgccgacgaggatatcaatctcggtctgggacagtgagatgagcgacagcatgtcgggggtgaggctggtgcagccttcgggaatatggttaggtggcaccacgaaggcgtcaatgtcatcctgatgtgccagtatggtttgtgccatctcggcaagcacgggggcggcgaacacgctgcggacgtcgagtcgccagccgaagctgcgtagccgctcgatcaaactgacgatcatcagcgaatggccaccgagttcaaagaagtgatcgtgacggccgacctgcgtcagtcctaacaggtcttgccagatctgggttaaggcggcttctacctcgccgaccggggcttcatagccacgcgccaccacggaggatgagtcgggggcgggaagcgcctgacggtcaagtttgccgttgggggtgagcgggaaggcgtcgagcatcataaaagcgctgggcagcatgtactcggcaagatgctgggcaagctgctgacgtagttcggcgggaaccagttcaacaccgtccagcggccgcagataggcgaccagacgcttctggcccggttcgtcttcgcgggtgagaaccacggcctcgcgtacgccgtgacattgcaccaatcgggcttcgatctcgcccagctcaatacggaagccacgcaatttaacctggaaatcattgcggctgagatactcgatattgccgtcaggaagccagcggccgaggtcgccggtcttgtacatgtgggcatccggatcggcggagaacggatcggcagggaagcgctcggcagtcagttcggggcggttcagatagccacgggcaacacccgcaccggcaatatggatttcacctgcaacaccgagaggaacgggctggccttgggtatccagaatatagatccgggtgttggcaatcggatggccgatggggattttcctctcttcgccttcagtcagtgggatttcataggccgtggcaaaggtggtggtttccgttggcccgtacacatgtagcaggtgctgtggcgggtaatcgactctaaggcggatcgcaggacggatatcggcctgttcaccgccgaaaaggacataacgtaaacccgacaatgacggcgcgattaaactcgcgtattgattgaacaacgcggttgtgaggaaaagcgcactgacgccttccgatgataaacgctgaccaaaataatcaggttgtaataaggttttttccgggatcaacaggatacgtgcgccatgcactaaaccagaccatacctcccaggtggccgcatcgaatgagacgttggcgcaatgggcaatacagtcatcggggctaatatcggcaaaaccattattgataatcagacgcaggacattgcggtgctcgaccatcacccccttgggtaatccggtggagccggaggtgtagatgacatacgccagatggcgtgacgtcagccccagtgcctgagcgtccggattgtgggtcggttgtgtcgccagggatgattcttgggcatcgagcaccaccgtggttacggggctggttagtctatcgatctgtgctgtcagggtcagcaaagccaccggtgccgcatcatcgagcatataggccagccgctcggccggataggctggatcgagcggcacataggcgccgccggccttgaggacagccagcaggccgacgaccatctccgggctgcgttccagacaaattgccacccgatcgtccgggcgtacacctaaggcgatcagatgatgggccaggcgattggcacggcggttcagttcgccatagctgagtgtctgatcttcaaacacgacagcggtggcattgggacggtgtgtcgcctgagcttcgaacaattgatggatcagggcgtcctgcgggaagtccgtctgggtggcgttgaagtctaccagcaactgttgccgctccgaagctggcaggattggcagacgtgcgatggcttgtgccgcatcggcggccatcgccgtcagcacctgcttaaagtactctaccatgcgctcaatggtcgttggatcgaacaagtccgaggcatattccagatcaccggtaagacccgtctcgttttcggtcagcgataacgtcagatcgaagtgggcgctataacgcgcctgttcaaccggagagagctgtaggctaggtaacgccagatcttgggcaggcgtgttgtttaaggttagcatcacctggaagaccgggctgtagctcaggctgcgttcgggctgtagcgcttctactacctgttcgaagggcagatcttgatgggcataggccgcgagtgcacgctcacgaacctgtgcgagcagatcggccacacggggcgcctcacccggcgtgacgcgcagggccagagtattgacgaagaaaccgatcaggctttctaactcttggtgtgggcggttagcgaccggagtaccgataacaatgtcatcctgaccactgagccgggagaggacgatgctccaggcggtcagtacagtcataaacaaggtggtgtgatggcgctgtccgagttccttaagcgatgccagtaaggtggtatcgagctggaaggacacctgatcgccgacataggtttgtaccgatgggcgtggccggtcggtggggagtgtcagtaaggccggggcgttctgaagctggctacaccagaagtcacgctgttcagtgaggacggcctcctgtaacccatcgcgctgccagacggaatagtcggcgtactgaatgggtagcggtggtaaaggatcgccgtggccgttgagggcggcgcggtagagggcgcccagttcgtgtaccagtacaccgacggaccaggcatcagcgatgatgtggtgctgggtaagcagcaacatatgtgattcgtctgtcagttgcagcagttgaccgcggatcagcgggccgcggacaaaatcgaagggtgtctgtgcttcgagggcggagagctcggcgatacgggtagtgtgcattgccgggttcagcggacgcaggtcttggcaggacagggcgaaattgacgtcagcgggatcgatgtgctggcagggctggccttcgactagcacgaagcgggtacgcaggctctcatgccgggcgaccaggcgatcgagggctgtggtcagggcatcgcggtcaagttgacccgtgagacgcagtaccaccgacatatggtaggccaggctggcggccggatcgagttggctgaggaaccacaaccgttgctgagcgaaggacaacggcagaggctgatgtcgatttacctgttcaatcaatggccgtcgctgctgacctccgcgggctttcaattgttcgtcaattttcttctccagaacagcccgtttcaggtcatcaagattcatgttaatccttgtcattggttattgtctccgcggttattgtccccgtctaacattgccagcaattcttctgttgacattaaatcaagcgagttttgtatcgattcaatatcgttttccccgaccgcattcatttgcgctgaaaagatgatgttggcctgttccgctaatttgggggaaaggaacaacgaagtgagggggatatcgaccaggaatttggcttttatacgtgttatcaattgcacgaccatcagtgagtgaccgccgagttcaaagaagtggtcgtgacggccgatgcgtaccagctccagcaggttttgccagatctgcgccagggccgtttctattcttccctgtggggattcatagccgcgtgccaccacggcggacgcatcgggggcagggagcgcctgacggtcgagtttgccgttgggggtcagcgggaaggcgtcgagcgtcataaaggcgctgggtagcatgtactcagcgagatgctgggcgagctgttggcgtagttcagcgggaaccagttcaacaccgtcctgaggccgcacataggcgattagacgcttgtggcccggttcgtcttcacgtgtcagaactattgcttcgcgcacgccgtgacattgcatcagttgggtctcgatctcaccgagttcgatacggaagccgcgcagtttgatctgaaaatcattgcggccgagatagtcgatgttgctgtcgggacgccagcggccgaggtcgccggtcttgtacatgcgggcatccggatcggaggagaacggatcggcgaggaaacgttcggcagtcagttcaggtcggttcaggtagccgcgggcaacaccggcaccggcgatatggatttcgccggctacaccaagaggaacgggctgacccagcgagttgagaatatagatctgcgtgttggcgatcgggcggccgatatgattgacaaagccctccgcccggttcatccgtatccaggttgaataagttgttgtctcagaaggaccatacagattgcacacatcctgtacggatgagtgggcaaacaaatgttcaatgacgtgcggtttcaatgcttcaccggccagattgaccgtccgggcggttatgggaactgccttggcttcgatcaagtgtgcgatggctgacggcaccgtgttgatcaggctgaccggctgctcggtggtgatcagtgacagcacatcaggaacgagatgaactgtgccgccggagagcagcggtgcaaagcattcgtacaccgccaaatcaaaattaagcgaggtagcaaaaagggtatgcgccaattcctccgggctgaaagtccgctgcgtccagatgaggaaattcacggtattgcggtgagtgatcgccacccctttgggcaggccggtggagccggaagtgtagatcacatacgccagatggtgtgacgttaaccccagcttctgcggttccggattgtgggttggctgtgctgctatagccgattcctggccgtcgagcaccaccgtaggcacggggctggacagtgtatcgatccacgccatctgggtgagtaaggccacaggtgccgcgtcatcaatcatatacgccagtcgttcggtcggataagccggatcgagtggcacataggcaccgcctgctttgaggatacccaataaaccgaccatcatttccgggctgcgttcaacgcaaatcgccacccgatcatccggacgtagccccagcgcaatcaggtgatgagccagacgattggcgcggcggttcagttcgccataactgagcgcttgttccccgcataccacggcggtggcggcgggattgtgcgctgcctgagcttcgaacagctggtggatcagcgtgtcctgcgggaagtctgcctgggtggcgttaaaatccaccacaatttgttgccgctcagaggctggcaggatggagacttgcaggattggctgttgcgggtcgcgaaccagggcatcgaccagaccgttgatggcggtggccagataagcggttacgcgaaccggatcgattccggccacggtctggacggtcagatggaaaccgacccccagatcatccaccgacagggtgagcgggtagttagttcgctcttcgattgccacgatgcgcatgcctgcccaggccgtgtcaattgcgtcggccttgtcgatttgactatgacggtaattaagcaaggcactgaacagcggcatcggctgggctacgccactacagcgttgtgccagcgctaacggtgcctgctcgtgctccagcagcgccgtcagactgcgataggtggcctgaaccacttcctgtacgctgcggtcggccagagaaacccgcattggcagggtattaataaacatccccagtatgcgatcagcgcccgcgaccccttgcaagcgacccagcagcacggagccaaagaccacgtcatcgcggccgctggtctgagccagcacctgagcccaggccacatggaacagcacgctcggactgacccccagacgccgggcctggacgcggatggtctccgccaaggcgggagcgagcgggagacgggcttcggcaacaggctggctatcgcctggcatcgtgagcacgccaaacggcgccgtcggcgcatcgacatcagcgagctgggtacggaaataggcctcatgtgctgtcgccggcacgttcagggtctgggcgataaaattgcggtagggcagtgcggcgggcagcgactcggcatgcccctgctggatttgggcaatctcagtgaaaatcagttccagcgtcatatggtcgctgaccagatggtggaagcgcagagccagcagccattcatcctgtgccggatcgtgggcgatatcggcggcgaacagcggtgcacgattcaggttgaggcggtgcagatgcggatcagtgtgggcgcgtaactgggctggaacgtcgtccgccgtagccggggtgaagagattgatccccagcggcgcctgacgccagaccacctgaaccggttttgtgagatcttgccagcaggcagcggtacgcaggatatcgtggcggtcgataacctgttgcagggcagccaggaaggtatcaagacgttcgcgggtgtcgaaagcaatcagactctgcaacagataggtatcgccttgtgcctgtagcaggtgatggaacaggataccctcctgcaacggcgccagtggatagatatcctgcacgttgctcgccccaccggggatcgtcccgacgatggactcaatttcggcctgagacagggagaccaagggcagcatgtcgggggtgagggcagtgcagcccttaggaatacggttaggcggtacgacaaaggtgtcggagtcgtcctgaatagcctgtgccatttcggcaaggacgggggcggcgaacacactgcggacatcgagtcgccaatcaaggtcacgtagccgttcgatcagactgacgatcatcagcgagtggccgccgagttcaaagaagtggtcgtaacggccgacccgctccagccccaacaggtcttgccagatctgcgccagagcggtttccgcctcgccgaccggagcttcatagccgcgtgtgatcacagcggatgaatcaggggcggggagtgcctgacggtcaagtttgccattgagggtgagcgggaaagcatcaagcaccataaaggcactgggcaacatatactcggcgaggtgccgggcaagttgctgacgcagttcggcgggaaccagttcaatgccggtctgtggcagcacataggcgatcaggcgcttctggcccggttcgtcttcacgtgccagcaccaccgcttcgctcactccgcgacattgcgtgagtcgggcttcgatttcgccaagctcaatgcggaagccgcgtagtttaacctgaaaatcattgcggccgagatagtcgatgttgccgtcggggcgccagcggccgaggtcgccggttctgtacatgcgggcatctggatcagcggagaacggatcggcagggaagcgttcggcagtcagttcaggacggttcaggtagctgcgggcaaccccggcaccggcaatatggatctcgccggccacgccgagaggaacgggctgcccctgtgggtcaagaatatagatctgcgtgttggcgatcggacggccaataggaatggagcgagtcacatcgacgggggaggcaatggcgtaggttgccgcaaatgtggtggtttccgttggaccatagccgttaatcaggtgtgtcggctgagattccgccaactgtgcacgtcgtatcttccgcgggtcgagtacatcgccgccgatgagcaggtagcgtaattgaccaaacaggggcttgagatcgctgagatattcgttaaacagaccggccgtcaaccagagggcggtaacttgtcccttgaccagcgaatcgcagaaacgtaccggatcgagtagtactgagggtgaaaccacatgcaaacgtcccccgttcagcagggcagaccagatttcccatgttgatgcgtcaaacgcaatattggcacaatgggcaatacagtcatcgggtccaatgtcggcaaaaccattattgataatcaggcgaaggacattgcggtgctcgaccatcacccctttgggtaatccggtcgagccggaggtgtagatgacatacgccagatgacgtgccatcagccccagtgcctgagtatccggattatgagccggttgcgccatcagggacgggtcttgggcatcgagtatgaccgtaggcacagggctggccagtgtatcgacctgtgccgcctgagtgagtaagactaccggcgcggcatcattgagcatatacgccagtcgctcggtcgggtaggccggatcgagcggcacataggcgccgcctgccttcaggatagcgagtaatcccaccaccaattccaaactgcgttccagacaaattgccaccggatcgtccggacgtacgcccaaggcgatcaaatgatgagccaggcgattggcgcggtggttcagttcgccatagctgagcacctgatcctcaaacaccacggcggtggcgtcgggacgctgcgccgcctgagcctcgaacagttgatggatcagcgcgtcctgcgggaagtccgtctgggtggtgttgaagtccaccagaagctgttgccgttccggggccgacagcatcggcagaattgcaatggtctgcgtcgcatcggctgccattgccgccagcacactctccagatagccgaccatgcgctcaacggtcgcagagtcgaataaatcggcggcatattctaagtcacccgccagacctgattcggtttcagtcagcgacaacgtcaggtcgaagtgcgcgctatggtgtgtctgttcaattgatgcaagctggagaccgggcaatgtcaggttttgagccggcgtgttgtttaaggccagcatcacttggaagaccgggctgtagctcaggttgcgttcgggttgcaacgcttccaccacctgctcaaagggcagatcctgatgggcataagcggcgagcgcccgctcacgaacctgcgcaagcaactcgtctacacgggtagtgttactgagtgtgacgcgtaaggctaaggtattgacgaagaaaccgatcaggttttccaactccgggtgcgggcggttagcgaccggagtgccgataacgatatcatcctggccactgagccgggcgagaacgatattccaagcggttagcacggtcataaacagggtggtgttatggcgttgtcctagccccttgagcgacgccagcaaagtggcatcgagctggaaggatacccggccgccggcataggtctgcaccgacggacgtggccggtcggtggggagtgtcaataaggccggggcgtcctgaagctgggcgcaccagaaattgcgctgctcagtgaggacggttccctgcaaccagttacgctgccaaacagcatagtcggcgtactgaatgggcagtggcagcagcggatcaccgtggccgtcaagggcggcgcggtagagggcgtccagttcgtacatcagcaccccgatggaccagccgtcagcgataatgtgatgcagggtaagtagcaacaaatgcgcttcatccgtcaattgcagcagttgactgcggataagtgggccctgagcaaaatcgaagggcgtctgtgcttcgaaggtggcgagttcggcaatacggtggatgtgtgccgcggattccagcggacgcagatcctgatagggcagggcaaagtcgatgtcggcgggagcgatatgctggcagggttggccatcgaccaggacaaagcaggtgcgcaggttttcatgccgggtaattaggcgctcgagtgcagtggtcagcgcgtggcggtcaagctggccggtgaggcgcagcgctaccgggatatggtaagccagattggcggcgggatcgagctgacccaggaaccacaatcgctgctgggcgaaagacaacggcagcagccggttgcgatcggctgtgggaataacgacctgagcggttgtcgccgctccgctgagtgcctgagccaaatccgtcaggatgggcaggtcaaacagttgctgtagaggcaactcccgcgccagatcttggcgcacgcgtgccaccagttggacggcaagcagcgaatggccgccgagttcaaagaaatggtcgtgacggccgacctgctccagtcccagcaggtcttgccagatctgcgccagagcggtttccgtctcgccgatcgggtcggcatagccgcgcatcacgatggcggactgatcaggtaccgggaatgccggacggtcgattttgccgttgggagtgagcgggaaagcgtcgagcgtcataaaagcgctgggcagcatatactcggcgatgtgccgggcgagttgctgacgcagttcagccggcaccagttcaacgcctgcctgaggtagtagataggcgatcaggcgcttgtgacccggttcgtcttcacgcgccagaaccaccgcctcgcgtaccccgtgacattgcaccagccgggcttcgatttcaccgagctcgatacggaagccacgcagtttaacctgaagatcattgcggccgaggtattcgatattgccgtcgggtcgccagtagccgaggtcgccggtcttgtacatacgagcgtcaaggtctgaagagaacggatcggtaaggaagcgctcggcagtgagttcggggcggttcaggtagccgcgggcgacaccggcacccgcgatatgaatttcgccggtgacaccgagaggaacaggctgcccttgtgtatccagaatatagatctgggtattagcaatcgggtggccgatgggaattgtcttacattcgctgtcagtgaatggaatttcataggaggtggcgaaggtggtggtctctgttggcccatacacatgcagcagatgctgtggcggataatcagctctaaggtggatcgcaggacggatatcgatctgttcaccgccgaaaaggacataacgtaaacccgacaatgatgaggcaatcaaactcgcgtattgattgaacaatgcagttgtgaggaaaagcgcactgacgccttccaatgctaagcgctgaccaaaatagtcgggttgtagtaaggttttttccgggatcaacaggatacgtgcaccatgcactaagcccgtccacacctcccaggtggccgcatcgaatgaaacattggcgcaatgagcaatacagtcatcggggccaatatcggcaaaaccattattgataatcaggcgcaggacattgcggtgctcgaccatcacccccttgggtaatccggtggagccggaggtgtagatcacataggccagatggcgtgacgtcagacccagtgcctgagcatccggattgtgggtcggttgtactgccatagccggttcctggccgtcgagtatcactgtggggatggaatgagccaacttatcgacttgtatcgtttgggtcagcaaggccaccggtgcggcgtcatcgagcatataggccagccgttcggccggataggttggatccagtggcacgtaggcaccgcctgacttgagaataccgagcaggccgaccaccagttctaagctgcgttccagacaaatcgccacccgatcatccggacgtacgcccaaagtgatcagatgatgagccaggcgattggcgcggcggttcagctcgccatagctcagtccctgatcctcaaacaccacggcgatagcatcgggataacgcgccgcctgaacttcgaacaattggtggatcagcgcgtcctgtgggaattccgcctgagtcgcattgaagttcaccagcagttgttgccgctctaatgacggcaagatgggcacatttcggatcaactgttgcgggtcgcgaaccagggcatcgaccagaccactgatggcggtaaccagataggcggttacgcgggtcggatcaattccggccacggcctgagcagtcagatggaaaccggttcccagatcatcgaccgacaggatgagcggatagttggtccgctcctctgtggcgacgatgcgcatacctgcccggctcgtctcaaccgcgtcggactcgctggtctggctgtgacgataattgagcaaagcactgaacagcggtatcgactgcgccatgccactacagcgttgtgccagcgccaacggtgcctgctcgtgctccagtagcgtcatcaaatcgcggtaggtggcttgtactacttcccgtacactgcgaccagccagagagactcgcactggcaaggtattgataaacatacccagtattcggtcggcaccagcgcccccttgcaagcgacccagcagcacggagccaaagacgacatcgtcgtgaccgctggtctgtgccagtacttgggcccaggccacatggaacagcacgcccggactgacgcccatgagacgggctgcggcacggatggcctccgccagagcgggagtgagcgagagaccggcttcggtgatggattcgctatcgctcggtatcgtgagtacgccgaacggtgccgtcggtgcgtcgatgtcagcaagctgggcgcggaaatagtcctcatgtactgcggccggcacgctcagggtctgggcgataaagttgcgatagggcaatgcggcgggcagcgattcggcttgcccctgctggatttgggcaatttcagcgaaaatgagttccagcgtcatatggtcgctgaccagatggtggaagcgcagagccagcagccattcatcctgtgccggatcgtgggcgatgtcagcggtgaacagcggcgcgcggctcaggtcgagacgatgttggcgcggatcggtgtgtgctgataactgagccgggatatcatccgccgtggctggggtgaagcgattgacacacagtggcgcctgacgccagaccacctgaaccggctgcgccagaccttgccagcaggcagccgtgcgcaggatatcgtggcggtcgatgacctgttgcagggcggttaggaaagtatcaagatgctcgcggctgttaaaggcgagcaggctctgcaacagataagtatccccttgagtctgcaacaggtgatggaacagaataccttcctgcaacggtgccagtggataaatatcctgcacattgctcgctccgtcgggagttgcctcgacgatggcattgatctcagcctgagacagcgagaccagagacagcatgtcgggagtgaggatagtgcaattttcgggaatacggttgggtggcaccacaaaggcgctggcgtcaccctgaatagcctgcgccatttcggcgaggacgggggcggcgaacacactacggacgtcaagccaccagccgaagccgcgtagccgctcgatcagactgacgatcatcagagaatggccgccgagttcaaagaagtggtcgtgacggccgatttgctccagccccaacaggtcttgccaaatctgcgccagaatggcttccgcctcaccgaccggggtttcgtagccgtgtgcgaccacggcggacgcgtcgggggcaggaagtgcctgacggtcgagcttgccgttgggggtgagcgggaaggcctcaagtgtcataaaggcgctgggcagcatgtactcagcgaggtgccgggcgagttgctgacgcagttcggcgggaaccagttcaacgccgtccagaggccgaagataggcaatcaggcgcttctcccctggctcgtcttcgcgtgccagtaccaccgcctcgcgcacgccgtgacattgcatcagttgcgcctcgatttcgcccagctcaatgcggaagccgcgcagtttgacctgaaagtcattgcggccgagatagtcgagattgccatcggagcgccagcggccgaggtcgccggtcttgtacatacgagcgtccggatcggcggagaacggatcggcaaggaaatgttcggcagtcagttcggggcggttcaggtagccgcgggcaacgccggcgccggcgatatgaatttcgccggtcacaccgaggggaacaggatgacccagcgagtcgagaatatagatctgggtattggcgatcgggcggccgatatgactgacaaagccctccgcccggctcatccgtatccaggttgaataggtcgtcgtctcagagggaccatacagattacacacattctgtatggattcacgggcaaacaaatgctcaatgacgtgcggtttcaatgcctcgccggccaaattgaccgtccgggtggtcatggggatcgcatcagattcaatcaagtgtgcgatggccgacggcactgtgttgatcaggctgaccggctgttctgtcgtaagcaatgacagcacattggggacaaggtgaaccgtgccgccagagagcagcggtgtaaagcattcgtacaccgccagatcaaaattaagtgaggtggcaaaaagggtatgcgccaactcctccgggctgaaagtccgttgcgcccaagtgaggaaattcacggtattgcggtgagtgatcgccacccctttgggcagtccggtggagcctgaggtatagatcacataggccagatggcgtgacgtcagccccagtgcctgtgtatccggattatgatccggttgcgctattagagacgtgtcttgggcgtcgagcaccaccgtgggcacggggctggccagtgtgtcgatccacgtcgtctgggtgagtaagaccactggagccgcgtcatcgagcatatacgccagccgttcggccggataagccggatcgagcggcacataagcgccgcctgctttgagaatagcgagcaggcccaccaccatctccgggctgcgttccagacaaatcgccacccgatcgtccgggtgtacgccttgggcgagcagatgatgagccaggcgattggcgcggcggttcagttcgtcatagctgagcgcttgctccccacatactacggccgttgcgtcagggctgtgtgccgcctgagcctcgaacagttggtgaatcaaagcgtcctgcgggaagtccgcttgggtggcgttgaagttcaccagcagctgttgccgctccgaggccggcagcatcagtagacccgcaacagtttgtgtcgcatcggctgccatcgccgccagtacattttccagatagccgaccatgcgttcaacggtcgcggggtcgaacagatcggcggcatagatcagatcacccgccagacccgcctcggtttcagtcagcgacaacgtcaggtcgaagtgcgcgctatggtgtgcctgttcaacccaagaaagttgcagatcgggtaatacgagattctcagccggcatgttgtttaagaccagcatcacctgaaagaccgggctgtagctcaggctgcgttccggctgaagcgcttccaccacctgctcaaaaggcaaatcctgatgggcataggcgctaagcgcccgctcacggacctgcgcgagcagatcggccacacgaggcgcattacccggcgtgacgcgcacggccagagtattgacgaagaaaccgatcaggttttccaactctgagtgtgggcggttggcgaccggggtaccgataacaatatcatcctgaccactgagccgggtgaggacgatgctccaggcagtgagcacagtcataaacagagtggtgttatggcgttgtccaagccccttgagtgatgtcaacaaggcggtatcgagctggaaagacacccggccgccgacataggtctgcacgggtgggcgtggccggtcggtggggagtaccagcaaggccggggcgttctggagctgagcgtaccagaagtcacgctgctcagtgagggccgttgcttgcagccggtcgcgctgccaaatggcatagtcggcgtactggagagacagcggcggcaggggatcaccgtggccgtcgagagcggcgcggtagagggtgcccaattcatgcaccaacaccccgatggaccagccgtcagagatgatgtggtgctgggtaagcagcaacatatgcgcttcatctgtcaattgaagcagttgaccgcgaatcaatggtccttggataaagtcaaagggtgcctgcgcttcgcgggcagcgagatcggcgatacggttggtgtgtgccgcgggttccagcaggcgcagatcctgacaggacagggcaaagccgatgtcagcgggatcgatatgctggtagggttggccctcgactaggacaaagcgggtacgcaggctttcatgccgggcgaccagacgattgagcgcggtggtcagcgcgtggcggtcaagttggccggtgaggcgcagggctaccgggatatggtaggctagactggcggccggatcgagctgaccaaggaaccacagccgctgctgggcgaaagataacggtagcagccgactgcgatcggcggcggggatgacgacctgagcggttgccaaagtcccgctgagtgcctgagccaaatccaccagaagaggcaggtcaaacagttgctgtagcggtaactcctgcgccagatcctgacgtacgcgtgccaccagttggacggcaagcagcgaatggccgccgagttcaaagaaatggtcgtgacggccgatctgttccagtctcagcaagtcttgccaaatctgagccagcgcgatttctatttcaccgagcggggcttcatagccgcgtgtcaccacggcggacgcgtcgggggcaggaagtgcctgacggtcaagtttaccgttgggggtgagcgggaaggcgtcgagcaccataaaggcgctgggcagcatatactcggcgaggtactgagcgagttgttgacgtagttcggccgacaccagttcaatgccggtctggggcagcaaataggcgatcagtcgcttgtgaccggattcatcttcgcgcgccagtaccacggcttcgcgcacgccggggcattgcattaatcgcgcttcaatttcgcccagttcgatacggaagccacgcagtttaacctgaaagtcattgcggccgaggtattcaagattgccgtcggaacgccagcggccgaggtcgccggtcttatacatgcgggcgtccggggctgaggagaacggatcagcaaggaaacgttcggcagtcagttcgggtcggttcaggtagccacgggcgataccggcgccggcaatatagatttcgccggcgacaccgagaggaacgggctggccgtcatgatcaaggagatagatttgagtgttggcgatcggacggccgataggcggtgctccttcttgctggctatcacacagataaatggccgcacagaccgtactttccgtcggtccataggcattgaccatacgccgaccagtagcccagcgtttgaccaatgagggtgagcaggcctcaccgcctacgatcagggtttgcagtgttactggtactgaatccagtgccgccaacgcggttggcgacagcagcacatgggtaatggcatgggtctccagagtattcaacagggcagcacccggcaggaggtgagttcgctgggcaagatggaggctggcaccggccagaagtgccatgctgcattcccagataccggcgtcgaagctgtttgaggcaaattgcaggatacggctgctgggcttgattgccagagtgtcctgctgagtggcgatcagattgctcaggccgcgatgctcgaccatcacccccttgggtaaaccggtcgagccggaggtgtagatgacatacgccagatggcgtgacgtcagacccagcgcttgcgcgtccggattgtgagtcggttgcgtcatcaggagcggttctgagccgtcgagtacgatcgtgggtatggcgctggccagtgtgtcggtcaatgctgtttggatcagcaaggccaccggtgctgcgtcgtcaagcatatacgccagtcgctcggccggataagccggatcgaggggcacataggcgccgccggccttgagaataccgagcagacccacgaccagatccaggctacgttcgacacaaatcgccacccgatcatccggacgcacacccaaggcgagcagatgatgagccaggcggttagcacggtggttcagttcgtgataactcagcgattgaccttcaaacaccacggcgatggcgtcgggatggtgcaccgcctgagcctcaaacaattggtggatcagcgcatcctgcggaaaatccgtctgggtggcgttgaactctagcagtagttgttgccgttctaacggcggtaagatcggcacatcccggagcaattgttgcgggtcgcgggccagggcatcgactaggccgctgatggcggtaaccagataggcggttacgcgagccggatcgatcccggccatggtcagagcggtcagatggaaaccggttcccagatcatccaccgacagggtgagcggatagttagtccgctcccctgtggcgacgatacgcatacctgttcggggtatatcaacggcgtctgccccgctggtttggctgtgacggtaattaagcaaggtactgaacagtggtagtgattgcgccacgccgctgcaacgttgtgccagtgccaacggagcctgttcgtgctccagcagcgtcgtcaggctgcgataggtggcctgtaccacttcctgcacactacggccggccagagaaacccgtaccggcagggtattgataaacatccccaatatttggtcagcgcccgcgaccccctgtagacgacccagcagcacagagccgaagacgacatcgtcatggccgctggtctgtgccaacacctgagcccaggccacatggaacagcacgcccggactgacccgcagacggcgcgcctgaacgcggatggcctctgccagagcgggggtgagcgggagacgggcttcggcgatggattcgttatcgcccggcatcgtgagcacgccaaacggcgccgtcggtgtgtcaacgtcagcgagttgggtacggaagtaggtctcgtgcactgcggccggcacactcagggtctgagcgataaagttgcggtagggcagtgcggcgggcagcgactcggcatgcccctgttgaacttgggcaatttcagcgaaaatcaactccagcgtcatgtggtcgctgaccagatggtggaagcgcagtgccagcagccattcatcctgtgccggatcgtgggcgatatcggcagcgaataatggcgcacggctcaggtcgagacgatgccggcgtggatcggtgtgagttaatagctgagccgggacattgtctgccgtggccggcgtaaagtgattaacatacagcggcgcctgacgccagaccacctgaaccggctgcgcgagtccctgccaacaggcagcggtgcgcagaatatcgtggcggtcgatgacttgttgcagggcaaccaggaaggtatcgagatgctcgcggctgtcaaaggcgagcaggctctgcaacagataagtatcgccttgagtctgcaacaggtgatggaacaggataccctcctgcaacggtgccagcggatagatatcctgcacattgcccgctccgccgggagttgcctcgatgatagtctcaatctcagcctgggacagcgagacgagggacagcatgtcgggggtaagggcggtgcaattttcggggatacggttgggcggcacgacaaaggcgttggtattatcctgggtggactgcgccatttcagcaagaacgggggcggagaacacactacgaacttcaagccgccgcccgaagccgcgtagccgctcgatcagactgacgatcatcagtgaatggccgccgagttcaaagaagtggtcgtgacggccgacccgttccagccccagcaagtcttgccagatttgcgccaggatggtttccgcttcaccgaccggggcttcatagccgcgtgcgactacggcggacgcgtcgggggcggggagcgcttggcggtcgagtttgccgttgggggtgagcgggaaagcgtcgagcgtcataaaggcgctgggcagcatgtactcggcaagatgccgggcgagttgctgacgcagctcggcgggaaccagttcaatgccgtccagcggctgcacataagcgaccagacgcgggtggccgggatcgtcttcgcgtgccagcaccaccacctcgcgcacaccgtcacattgcatcagttgcgtctcgatttcgccaagctcaatacggaagccgcgcagtttgacctgaaagtcattgcggccgaggtattcgagattgccgttgggacgccagcggccgaggtcgccggtcttgtacatgcgggcatccggatcggaagaaaaaggatcggccgggaaacgttcggccgtgagttcgggtcggttcaggtagccacgggcagtgccggcgccggcgatatgaatttcgccggccacaccgagaggaacgggttgcccgtaggcatcgagaatatagatccgggtattggcgatcggacggccgataggcggagcgccttcttcttggttatcgcacagataaatagccgcacagaccgtactttcagtgggtccataggcattgaccatacgccggccgacagcccagcgtttgaccagcgaagatgggcaggcctcaccccccacgatcagggtctgcaatgtcacagggactgaatccagtgccgccagcgcggtgggtgacagcagcacatgggtaatggcatgagtctccagcgtctccaacagggcagtgccaggtaggaggtgagttcgctgagcaagatggaggctggcgcccgccagaagtgccatgccgcattcccagataccggcgtcgaagctgtttgaggcaaattgcaggatacggctgtcgggattgatcgccagagtgtcctgctgagtggcgatcaggttgctcaggccgcgatgctcaaccatcacgcctttgggctgtccggtggagccggaggtgtagatgacatacgccagatggcgtgatgtcagccccagtgcctgagcatccgggttatgagtcggttgcgctgccagagatggcgcgagtgcgtcgagcatgactataggcacggggctgaccagcgtgtcgacctgtgctgtctgggtcagcagggccaccggtgcggcgtcaccaagcatataggccagccgttcggccggataggttggatcgagcggcacataggcgcccccggccttgaggatagcgagcaagcctatcaccagttccgggctacgttcgacacaaatcgccacccgatcatccgggcgcacacccagcgcgatcaaatgatgagccaggcggttggcgcggtggttcaacttgtgataactcagtgattgaccttcaaacaccacggcggtggcatcaggggagtgtgccgcttgggcttcgaataattggtggatcaaggcgtcctgcgggaaatccgcttgggtggcattgaaatcggtcagcaacagtcgccgctctgaggccgacagcatcggtagacccgcaacagtttgtgtcgcatcggcagccatcgccgtcagcacattctccaaataaccgaccatacgctcaacagtcgcagagtcgaacaggtcggtagaatattccagatcaccaaccagaccggcctcagtttcggtcagcgataacgtcagatcgaaatgagcactatggcgcacctgttcaacgggagcgagttgcagaccgggcaatgccaggttttgggacggagtattgtttaaagccagcatcacctggaagaccggactgtagctcaggctgcgctcgggctgcaatgcttccactacctgctcgaagggcaaatcctgatgggcataggcagcaagcgcccgttcacgaacctgcgtgagcagatccgccacacggggagcctcacccggtgtgacgcgcaaggccagggtattgacaaagaaaccgatcaggttttccaactccgtgtgtgggcggttagcgaccggggtgccgataacaatatcatcctgaccactcagccgggtgaggacgatgctccaggcggtcagcaaggtcataaacagggtggtgtgatggtgctgtccgagcgccttaagcgatgccagcagggcggtatcgagctgaagaggtatccggtcgccagcgtagcgctgcaccgacgggcgtggtcggtcggtggggagtgtcagcagagccggggcgttctggagttggctgtaccagaaatcacgctgttcagtgaggacagcgccttgcagccagtcacgctgccagacggcatagtcggcgtactggagagatagcggtggcaggggatcatcgtggccgtcgagggcggcgcggtagagcgcgcccagttcgtgcatcaggacgccaatggaccagccgtcagcgatgatgtgatgctgggtgagcagcaatacatgctccgcgtccgtcagttgcagcagttgaccgcgaatgagcggctcccgcacaaagtcgaagggtgtctgggtttcgaaggcggtaagctcggcgacacgattcgcacgcgccgtcagatccaacgggcgcagatcttggaaagacagagtaaagccgatatcggcgggatcgatgtgctggcagggttggccttcgatcaatacaaatcgggtgcgcaggctttcgtgccgggcgaccagacgatcgagcgcgctggtcagcgtgtgacggtcaagtttaccggtgaggcgcagtgctatcggaatatggtaggccagactggcggcgggatcgagctggccgaggaaccacaaccgctgctgcgcgaaggacagcgcgagcggctggctgcgattggcagcaggaataacaacctgagcgattgccgaagcgtcggtgagcgtctgagccagatccgtcaggaggggctgggcaaagagttgctgcaatgacagcttctgtgccagttgctggcgtacgcgtgcggcgagttggacggcaagcaatgagtgaccgccgagttcaaagaagtggtcgtgtcggccgacctgttccagtttcagcaggttttgccagatctgagccagtgcgatttctatttcaccgaccggcgcttcatagccgcgtgtcactatggcagacaggtcgggggcagggagcgcctgacggtcgagtttgccgttgggggtcaacgggaaggcgtcgagcgtcataaaggcgctgggctgcatgtattcggcgaggtgttgggcaagctgctggcgcagttcggccggcaccagttcaacgccggtttgtggcagcagataggcgaccagacgcttgtggcccggttcgtcttcacgggccacaaccacggcttcgcgcacgccgtggcattgcaccagccgggcttcgatttcaccgagttcgatacggaagccgagcagtttaacctgaaggtcattgcggccgaggtattcgagattgccgtcgggtcgccagtagccgaggtcgccggtcttgtacatacgggcgttcgggtctgaagagaacggatcggctaggaagcgctcggcagtcagttcagggcggttcagataaccgcgggcaacgccggccccggcaatataaatttcgccggcgacaccgaggggaacgggttgaccataagagtcgaggagatagatttgggtattggcgattggacagccgataggaatgggacgagtcacatcgacgggtgaggtaatacgataggttgcggcaaacgtcgtggtttccgttgggccatagccgttgatcaggtgtgccggctgacactcagccaactgtgcacgctggatcttccgcgggtcgagtacatcgccgccgatgagcaggtaacgcaattgtccaaacaggggttcaagatcgccgagatattcgttaaacaagccggccgttaaccagagggcggtgacttgtcctttgaccagcgaatcgcggaaacgtaccggatcgagcagcgctgatggtgaaactacatgcaggcgcccgccgttcagcagggcagaccagatctcccatgttgatgcatcaaaggcaatattggcacaatgggcaacacagtcgtccgaaccgatgtctgcatagggattattgatgaccagccgattgatactgcggtgctcgaccatcactcccttgggcagcccggtggagccggaggtgtagatcacatacgccagatggcgtgacatcagccccagtgcctgagcgtccggattgtgggtcggttgtgctgctatagccgattcttgggcgtcgagtaccactgtggggatatgatggatcagcttgtcgatctgtgtcgtttgggtcagcaaggccaccggcgcggcgtcattaagcatataggccagtcgctcggccggataagccggatcgagcggcacataggcgccgcccgccttgaggataccgagcaagccgatcaccagctccagactgcgttcgacacaaatcgccacccgatcatccgggcgcacgcccagcgcgatcaaataatgagccagacgattggcgcggtggttcagttcgtgataactcagcgattgaccttcaaataccacggcggtggcatcgggatggtgcgccgcctgagcctcaaacaattgatggatcagcgcgtcctgcgggaagtccgactgggtggcgttgaaccccaccagcagttgttgccgctctgtcggcggtaagatcggcacattccggatcaatcgttgcgggttatgtgccagggcatcaactaagccgctgatggccgtgacgagataggcggtgacgcgggtcggatcgattcccgccaccgtctgggcggtcagacggaaaccggttcccagatcatcgaccgacagggtgagcggatagttggttcgttcctctgtggcgacgatgcgcatccctgcccgggtcgtctcaaccgcgttggcctcactggtctggctgtgacggtaattaagcaaggtactgaacagaggcatcggttgggtcacactgctacagcgttgcgccagtgctaacggtgcttgttcgtgttccagcagcgttgtcagactgcgataggtggcctgcaccacctcttgcacgctgtggccggccagagaaacccgcaccggtagggtattgataaacatccccaatattcgggcagcgcccgcgaccccttgtagacggcccagtagcacggagccaaagaccacgtcgtcgcggccgctggtctgcgccagtacctgagcccaggccacatggaacagtacgcccggactgacccccagacgacgagcctgggcatggatagcttctgccagagcgggggtgagcgggagatgggcttcggcaatgggttcatcattgcccggcagggtgagcacgccgaacggtgtcgtcggtgcatcaacgtcagcgagttggtcacggaagtaggcctcatgcactgcggccggtacgctcagagtctgggcgataaagttgcggtagggcagtgcggcgggcagcgactcggcatgcccctgctgaatttgggcaatctccgcgaaaatcagttccagtgtcatatggtcgctgaccagatggtggaaacgcagcgccagcagccattcatcctgtgccggatcgtgggcgatgtcagcggtgaacagcggtgcacggctcaggtcgagacggtgccgacgcggatcggtgtgggctgataactgagccgggatatcgtcggccgtggccggtgtgaagtgattgacacacagtggcgcctgacgccagaccacctgaaccggctgcgccaacccctgccagcaggcggcggtgcgcaggatatcgtggcggtcgatgacctgctgcaaggcggacaggaaagtatcaagatgctcgcgggtgttaaaggcaatcaggctctgcaacaaataggtatcgccttgcgcctgcaacaggtgatggaacaggataccttcctgcaacggtgccagcggatagatatcctgcacattgcttgctccgccgggagttgcttcgacgatggcctcaatctcggcctgagatagcgagaccagagacagcatgtcgggggtgagggcggtacagccttcggggatacagttaggcggtacgacgaaggcactggcgtcactctgaatagcctgcgccatctcagtgagaacgggggcggcgaacacactgcggacatcaagtcgccaaccaaagtcgtatagctgttcgatcagaccgacgatcatcagcgaatggccgccgagttcaaagaagtgatcgtgacggctgactcgctccagccccaacaggttttgccagatctgcgccaaggcggtttctgcctcactgatcggggcttcatagccgcgtgccaccacagcagacaggtcgggagcagggagtgcctgacggtcgagtttgccgttgggggtgagcgggaacgtatcgagcgtcataaatgcgctgggtaacatgtactcggcaagatgccgggcgagttgctgacgcagttcggcgggaaccagttcaacgccgtccagaggccgcagataggcaatcagacgtttctgtcccggttcgtcttcgcgtgccagcaccaccgcttcgcgcacaccgcgacattgcatcagttgcgcctcgatctcaccgagttcgatacggaagccacgtagtttgacctgaaaatcatcgcggccgagatactcgatattgccgtcggggcgccagcggccgaggtcgccagtcttgtacatccgggcatttgaatcggcggagaacggatcagtaagaaagcgctcggcagtcagttcggggcggttcaggtagccacgggccacaccggcaccggcgatatggatttcgccggccacgccaaggggaacgggctgaccgtaggcatcgagaatatagatttgcgtgttggcgatcgggcggccgatatgactgacaaagccctccgtccggttcatccgtatccaggttgaataagtcgtcgtctcagaggggccatacagattgcacacattctgtatggaggcgtgggcaaacaaatgctcaacgacatgcggtttcaatgcttcaccggccaaattgactgtccgggcggtcacgggaaccgcgttagcctcgatcaaatgcgcgatagctgacggcacggtattgatcaggctgaccggctgtccggtggtgaccagtgacagcgcatcaggaacgagatgaaccgtaccgccagagacgagtggcgcaaagcattcgtacaccgccaagtcaaaattcagtgaggtggcgaacagggtatgcgccaactcctctggattgaaagtccgttgcgcccaggtgaggaaattcaccgtattgcggtgggcgatcgccacccctttgggcaggccggtggagccggaagtgtagatcacatacgccagatgacgtgacgtcagccccagcgcctgtgcctctgggttgtggatcgattgtgccgacagagccggtgcttgggcgtcgagtaccaccgtaggcacggggctggtcagcgtatcgacccacgccgtctgggtgagcaaggccaccggtgcggcgtcatcgagcatataggccagccgttcggcaggataggccggatcgagtggcacataggcgccgcccgccttgaggatacccaataaactgaccaccatctccgggctgcgtgtcatacaaatcgccacccgatcgtccggctgtacgcccagtgcgatcagatgatgggcgagacgattggcgcggcggttcagttcgccatagctgagcacttgctccccgcataccacggcggtggcatcgggactgtgtgccgcttgagtctcgaacagttggtggatcagggcatcctgtgggaagtctacttgggtggcgttgaagtccaccagcaactgttgccgttccgagtctggcagcattggcagacatgcgagagtttgtgtcgcatcggctgccattgctgtcagcacctgctgcaaatagccgaccatgcgctcaacggtcgcggtgtcgaacagatcggcggcatattccagccccccgaccagacccgcttcggtttcggtcagcaacagcatcaggtcaaaatgcgcgctatgactctcctgttcaacctgagagatctgcaaactgggtaatgtctggtcttgggccggcgtgttgtttaaggacagcatcacctgaaagaccgggctatagctcaggctgcgttcgggctgtagcgcttctaccacctgctcgaagggcagatcctgatgggcataggcggcgagtgcacgttcacggacctgtgcgagcaaatcggctacacggggcgcatcacccggtgtaacgcgcagggccagagtattgacgaagaaaccgatcagaccctccaactcgcggtgtggacggttagcgacgggggtgccgatgacaatgtcatcctgaccactgagccgggtgaggacgatgctccaggcggtcagtacggtcataaacagggtggtgttgtggcgttgtccgagcgccttaagcgacgtcagtaaggcgctgtcgagccggaaggggacttggccgccggcatagcgctgtacgggtgggcgtggtcgatcggtagggagtgccagcaaggccggggcattctggagctgcgcacaccagaagtcacgctgctcagtgaggacggttccttgcagccagtcgcgttgccagaccgcatagtcggcgtactggagggacagtggcggcaggggatcgctgtcgccgtcgagggcggcgtggtagagggtgcccagctcgtgcaccagcaccccgatagaccagccgtcagagatgatgtgatgctgggtgagcaacaacacatgctcctcgtccgtcaattgcagcagttgaccacgaatcagcgggccttgggtaaagttgaagggcgtctgcgcctcaaggtcggcaagttcggcgatgcggtgagcgtgcattgccgggtccagcgggcgcagatcctgataggacagggcaaagccggcgtcggcgggatcaatgtgctggcagggttggccttcgatcagtacgaagcgggtacgtaggctctcgtgccgggcgaccagacgatcgagcgcggtggtcagcgcgtggcggtcaagttggccggtaaggcgtagtgtcaccgggatatggtaggccagactggcggcgggatcgagttggccgaggaaccataaccgctgttgggcgaaggacagcgcgagcggctggctgcgatcggcggcggggataacgacctgagcggttgccgaagccccgtagagcgcctgggccaaatccgccagaagaggcagggcaaaaagttgctgtagtggtagttcccgcgccagatcctgacgtacgcgtgcggcgagctggacagcaagcagcgaatggccgccgagttcaaagaaatggtcgtgacggccgacccgctccagtctcagcaaatcttgccagatttgggccagaatggtttctatttcgccgaccggagcggcatagccgcgcgtgactacggcggacgagtcgggggcagggaacgctgaacggtcgagtttgccattgggggtgagcgggaaggcgtcgagcgtcataaaggcgctgggcagcatatattcagcaaggtgccgggtgagttgttgacgcagttcggcgggaaccagttcaacgccgtccattggccgcagataagcgaccaggcgcttgtgacccggctcgtcttcgcgcgccagaactaccgcttcgcgcacaccgtggcattgcatgagccgagactcgatctcaccgagctcaatgcggaaaccgcgcagtttaacctgatagtcattgcggccgaggtattcaatattgccgtcgggaagccagcgaccgaggtcgccggtcttgtacatacgggcgcccggatctgcagaaaagggatcggtaagaaaacgttcggcagtcagttcggggcggttcaggtagccgcgggcaacacctgcgccggcgatatgaatttcgccggcgacaccgaggggaacgggttgaccctgcgggtcaaggagatagatttgggtgttagcaatcgggcgaccgatgggaggaagagttggccactgatccatattcttgcccagcgtatatgccgtaaccacatggctttcagtcgggccatagtgattgtgcaactggcatgatccggagcgttgtagaaagtggcgaatggcaggcgtaatgcgcaactgctcaccagcggtaatgatgtgagccaagcaagaaaaatctccctcaatgcgactggccgcttcggcaagatgttgtagcgcaatgtaggggaggaagattctatcaatctgtttttgctgaatcaggcggaggaattgttgaggatcccgacgtgtttcttcattaatcaagaccagacatccgccttcgcacagcgtcgtaaatatctcctggaaagcgacatcgaatccaagagcggcaaattgtagcgttttaccggttccggatagatgtgaaggattttgacggtgccattgcaacaagttcgacaatgctgccagagacatttccactcccttgggcagacccgtggagccggaggtgtagatgacatacgccagatggtgtgacatcagccccagcgcctgcgtatccggattgtggactgactgcgccgtcatggcgaattcttgggcgtcaagtaccaccgtgggcacatggctggtcagcctgtcggtcagccccgtctgggtgagtaagaccaccggtgccgcgtcatcgagcatatacgccagccgctcggccggataagccggatcgagcggcacataggcgccgcccgccttaaggataccgagcaggcccaccaccatctcaaggctgcgttcgacacaaatcgccacccggtcgtccggacgcacgcccagcgcaattagatggtgagccaggcgattagcgcggcggttcaattcgtcatagctgagtgtctggtcttcgtacactacggcggtggcgttggggttgtgtgtagcctgagcctcaaacagtgggtggatcaacgcgtcctgcggcaagtccgtctgggtggcgttgaagttcaccagcagttgctgccgctctgccggcggcaagacaggtaaacttcggatctgggtctcgggagaagagagagcggcctccatcaacatggctaaacgcgattggagagccatgacttcagcgcagttcaggtagtgggttgagtaattgaattcaatcgtgacgggctgattgacagcctcatcgttagcgaatgcgtattggtaaatcgcgacgaagaaaggaaacggtgttccacgttgtatttttgagtatttgatcgtggcaccgggcatctcagcgttcgcttggaacgactcaaatgacagcatgatgtcaaatagttgagcgcgtcccgtcttctgctggatttgtgtatgccgattaatctccgcgatcggtaagcgctgacgtttatagcaacgacgcaactctgctgccgctttgcgcataacatcaaggaaggtgtcatgaggcgtaatggttatgccgacgggaatgactgacgagaacatgcccaacgtgcgtttttgcctggcattcttacggttgtgcacgggaatgccgatgacgatttcctccgcctgagtggtacgggcgaaatagcaagccagaacggcatacataaagtgcagaacagacaacccatgctcggtcacaatagcttcgatgcgctggaaaagccccttatccaattgccaaagtaccggttcggtttgtccgtgatctgtcgttttatccggattaggcggttggagcaatgcaggaggcaagttcacataacgttccaaccagaattgccggtcgtttacatagcgttgtgaatcgagataggcacgatcctcggcaataaaatcgagataggaaggagcggcttctggtagtgcctcccctctgattaagtgacgataagtgttagcaagctcttcgggaattagcgctaaattcgtagcatctccgatcaaatgatggcaacaaaaatgccagtaccagcgtgtatcactgactcgtagcagttcggcacgccataactccccattcaagtcgtatggacgcatgaaagcagtgcgtatgtgttgtgcggcttgggcttctgcgtcggcatgatgtgagaagtcgtgaattgtcacggacaccgggagcgtgtccacgagttcctgaagtggcagtttttgagtattgatgagtcgtaaacgcaatgcatcatgacgataaacaacggcttcaaaggcgcgtactaacagtgtttcatccagctttccatcaatgaggacaagtgaaccgagattgtagctggggctgtcaggatggagaatttggtcaagccagacaacttgttgggtagaactgagcgaaaatttgcaagaggaggattcagaggaactttcaaacgcaagctgatctttgttgatacgattgcatggcataggcattacttaactcctgctcgctaggctaatggatggaatgtgagttatgtgacgttgctggacattgaaaaatgagttatttcataaacagatactttatttttttaatctcacttataaaagagttagaattcatttatttttgataagtatcattaaaattactggtggtttggtcgtggtagattggatgctgcggtatcattgctgtcagtatatgtggcaattatttaataacattaaggtatttataaaatcagctttattacagcaacaacagagaatgaaaaaaggtatatcactatgattatatttaataaaattataacaaaataacattatttaaaaaattactgattgggtttatttattctatcaatattttacttggctgatttctataataagattattatttgttatttgttatttgttatttgttatttgttatttgttatttgttatataacatttgttattcatccttaatttaatattttactcaatgttttcaaagctaattctcttgtattcattaatagccattcaaaattaactttcgttttcttcaggtgattattattgttttataccacctttagtaataatataaaatgaaactaaaatagtatggttataattatttcattataactaaaaattatatatctatataacgacgcgtgatttaaatcacaaactaaaatatgattattaataataatcattgtcctcttattaataatttaaaatggaaggttgtaatgtctgatattattgtaacccaaagtaatgaagaaaaaatgtggtgggaagaagatgctggtttctttgggaaactatataaagaagcggatgattcaacgcagactttttttgaaggagaaaataatttagtacaaagaacaaataaagaggttgacggagttatcaatttatgtagtcttaaatcagggcagtatcttatcgattgtccctgtggatatggaaggcacagtgttgctcttagagaaaagggtatcaatgttatcggaatagatgttaatgaagaacacttatctattgcacgtaggcatgcagaagtacagaattcagatgtgattttcaaaaaagatgatatgcgtacattcaaagtggaaaggcaagtggatgcgctaataaatatgttttattcttttggatttttttccgatgaagaaaatgttaatgccgcaaggaatttttatgatgcattgaaaaagggcggtaaattccttatgcacaccatgataacagttcctgcattcggagatggtagaattccgttggaagaaaaaagaaaattgcaatcagggagaaccttagtttcaaaacgaagatttaatcatataacaaaaagagaagaggggatatggtctttattaaacgaaaataatgaagagatttctttgagaccatatgatgtgagaatttatactgatattgaattcaaagaactttgtcttgaagctggattttctaaagtcgaattatatggggattgggatggttctccatacaatgataattcaacttatttaattgtggttgctgaaaaatagaatgctaagtgtctttcttttaataaatatattttataaaaaatgatatatgtaaaatcagttaccctcattgacaaatttaagttttttgcggcgttgatgatgtttttttatcatatttcatctgaaaaatattcagtacgaatattcaaaatgaaatttacaaaaaatattttctaatgcgggttctatgggggtaactttttttgtttgagtggttttattcttgcttggtcgcagagtggacaaaaaatattcggtctgggtagattcggttaattaagtgcaattcactcaatgatgaaaatagatattgtcccagccagtcataacgaacagttcggttataacgttcgatataagtattctgctagggctttcccggctgaataaaattaatgttccttcgtccactcctgaaattcatggctggtgtattccgggccagtgtcacatcggattgaaacctattttcctccccattcaatgagcggttccaacgttcgtttaacacgactgctcggtaattattccatcgacaaagttcaggaacaggggttcccgcttcagcctgtttcaagatggctaagatctgactgtcagtaaagcgtgttttttgttttgcattcaattatcagcagacaagccgcattagcggtgcgtcagttcaaaatagattattttttagtgtgtggtttatatttgttttcttaaattttcataaaaataacatgttgttaatggtatgtttaaataatgtatatataatataattacacatttttcacgatatattttttacttttaaatcaaccgattgtataggtggtgaatgttttctaaataaaacatattgttgtaagtttagggtgaatagattttttattgcttatatgagtaagtgataaatattacctgttgtatgctattggtgataggaaataatatgaaaaagaaacttttatttgaagttatttcagagatagcatctaaaaatcctgaaaatattgctgtcaatttttgtggtaatacactgatttatagtcaattagaacagcaatctgacttattagcacattatttattatcaaaatatccaatgcatcgcaaagggaagatagcaatctatattgaacctggcctgatattgccagtggctttgttagctattttgaaagccggtttttcatacgtgccgatttcccatttttacccagtagaaagaatggcaaaaattttagatgactcttctgcttttttgttactctctacgcggtcgattattaataaaagagggctagacacgtggtttcactcagtgctcgctttagaagatattgacttctcagccccaacaaatacaggatgtttaccgaccgtatttagcaatgatttagcttatattttatatacctctggatctacagggatacctaaaggtgtcgccatagagcactgtaacttgagctattatgtagattggtttaatcaggatctttggtctcaaacgcaagcactattaccattaacgtcttcgcttagttttgctgctgcggtagcacagttatatgcaccattattgcgtggggacaccttgcatatcctgccagctgatagcttgtatgagcctgaagttttattcaactggtatcagcagtactctaatggagcgatttattgtgttcctaccatctgggatgaactactgaattatataattaatacgaataattcaattaccctccctaaagtggtctttctttctggtgaacctgtttcttgtgatttaaaagaacgtacttttcagcagctccctggcgtaagaatatttaatctctatgggccgacagaaacaacagcgaatggagcattcaccgaattagaaaaagaaaaaccggttactctgggaaaagcgttgcggggtagtgaaattattattgtgaatgacgatttacaatcggttcctgctgggcagagtggtgagatctgtatcatcggtgaaggtgttgcacggggatatgttaatcgtgaatctttgaccaaacagcgctttttcaattatacaacagagtatgttttcagcagaggatatcgtacgggagatttaggaaaagttaattctcaaggtgagatcatctatttaggacgcattgatcgtcaaatgaagattaatggtgtgcgaattgaacccgctgagatagagaaggttttacgtcaatttcctaacattaataaagcattggtctgtttattgagtgaaaaaacagaccagccgtatttggtcgcataccttgtcagtcaagaaaagcacatctcaatcagcgaaattagactgttcttgcggaagaaactaccggatgtgatggttccatctcactatctctttattgaaactttacctaaattacctaacggcaagctggatatcaatcgattaccattaccttgcccagttcgaccagagttaggatacccttgtgttaaagccgtcagcaatttgcaacaagatctaatcgatatttggcaggaggcattggggtttcgggagctaggtatccatgataatttttttgatttaggcgggaattctttacaagccattcaggtgagacagataattaagcgtagattgtcttgtgatattaattattctctattttttaataatgcaacccctcacttattatcttttattattcctgattacatcaatgataaggttgctgatgttagtgaagacgaaatactagatggagacaattgcttattatctgatgaacaaaattattttttgatgttagatcaaatcagcccagatcccacatcctattatattaatttctatctaattattaatggagagctaaacaattcagcaatcgaatggagcctaaagcgtattttggaatgtaattcagtgctacagagtcgttttgatcttgatgaattttctcgtattgaagaaaattatcctgtagagatgatacaaatattgcaacaggtctacacccgttctctggatttaattgacgaaatgaacattaaacatttactggattttgttgatttcccagaggtagatttagaacagactctacctatttcttttaaattactttctttggaaaaacaaaaaaatatattattagtcagtgtgcatcatgtcgtttttgatcatgattctattaatttgttttttaatcagtttattaattatatgcgagcctatatagccggggattttcattataaattaggaaatggaatacaatatcagcgatattgtcaatggcaaaaaaaaataaaacccatacgttatcagcaagagcagaaattttgggtgaagacgatggaagattaccttcttgctggtgcagatgcatctgaatttagaacgattgaagaggtaaaaggtgagaaccactggttttccatatcagtagaattaaccttggctctgacgcaatttgcaaaaaaacggaaaactaccctttttatttgtatgttgaccgcatttaacaagttacttaaatgtacccttcgttataaaaatagcgctattggtattccggtgtctaatcggatgctatatgaagacatctcactattaggttgttttgttaacatggtgacttattatgatgttataaatcctcacgatagtttcaggactatgttgttacgttgtcaacagaaaatgaatactatcctggataacccaatgtttccttataatgaattaatcaatgaagtacgcgctaaaggatggagtgagaagttacgtttccctgtttgttttaactacctatcgtcaatgcctgaaagaatatatttagatagttgtgaataccaaatcggctatattatgaataaacaagccagattcgaactgacactttctgtcaatgaagggaaatctttttcgctctgttttaactacgctaagaatgtatttaacatagatgaaataaaagagttatctgaaaaatatcactctttattatcggaaatgatatttgatgagtaatcgataaatacgctcagaaaatgtgtgttaaatagttaatgtatctataggaaaagcacatggcatctgaaaaaattattcattctaaggtcttactgcaaaccaataagacacccgatttaattgcgcttaggtgtgatgaaagtataataacgtatcaacaattagaacaacgttctaatgcattagctgattatttaattaaacatggcgtaaaacccggtaatattgttggtgtttatattaataaaggaattgatttggtaatcagtttgttaggaatattgaaagcaggaggatgttacttaccattagacccctattatcctcatgaacgcttgacatatatgattagtcattctaaaacagcatttattattactgataatgaacaaatattaacgttgtttcaatgcgactgtaattttattaatattaaaacactcaatttaacgctcaataatcaactgacactccctaaggtgaatgatgaccatctgtgttatgtcatgtacacatctggatcaacaggagtccctaaaggtgtgatggtgagtcaccggactgttgttaattatttggaatggatgcaaagcgagtttatcttaaagtatgaggacgtagtgcttaaccaatctacttttagttttgatgtttccgtttgggaaatcttctggccattaattgccggtgcaagctgcgcattaattacagaagagattaaattcgatccatttctaatagcaaaattcattacccgacaccatgtaacagtcgctcagtttgttcctacagcattaaggacaattgccggcgctaatgtattgtcaggctgtccatcgctaaaacatctatttgccggtggagaagtgcttgatcaatccttagttaatgagttaactgagcaatttaaggggcagattcacaacctatatgggccaactgaagcaacaatttttgcttgtcactggtattgccgggcgggagagaaagaaaaaacagtaccgattggtaaagccattccacatgctcgtacctatgtgctgaatgaatattttcaacccgttcccgttggtgagtgtggcgaactttatttagccggagatatcctggctaaagggtatctctacgaggagtcactgacccaaaaatgttttgttaacgactctttttcctgttatagcaaccaaaaaatgtatcgtacgggggatttagtaaaacaatgccctgataatatattggaatttataggcagaatcgatgatcagataaaaatgcgaggatatcgtattgaactgaaagaaatagaaaggcaccttttgtcccacccctatatcactcatgctgctgtagtgattgacgatcccccagaaaataaaaactcatcattatctgcatattatgtattacatcatcaacaatcagttaacgttcaggatataaaaaaatatctattaaaatttttaccttactttatgttaccttcttgttttattgaattagataaaattccggttcacccgaatggaaaaatagacaaatcaaattttagtttatatgtgaatgaaaataataagtattttgttgatgagaattcaaatacaggcattgaggaaataataatttcaatctggaaacctgtactgaacaaccgaaatttttcgaagcaggataatttttttgatattggggggaactctttacttatgtcaaaggtatataggcaaattaagaaaaaattctctgtccctatttcaataatggatttatttcagtacccatcagtacaaatgctgagtaggtatatttgtgaaaagcgtgcgggtattttgagagagaaggaataattcattgtaacttgatgacgtatagcgagataacaaaatgaaagatcaaaaaaaattgcacgagaaagatattgccattgtgggcatgtcagctcgttttcctggtgctgaagatgtcactctattttggcagaatttattagatggtgttgaaagtatcagcacattcagtgaagaagaattgcgggcatctggcgtagaagaagaagtgttagcctcaccaaattatatacgtcgccgtggtattttaggcaatgccctgcactttgacgctaatttttttgatatcacaccccgagacgcagaaattatggatccgcaacatcgggtctttctagaatgctgttggcatgcgtttgaagatgcgggttatgttcctgatacttatgctggcaaagtcggcgtgtttggtggtacgggtacggcatggcatctgaatacagtgaataaacaccctgatgtgctgaaatataccagcggcgcttcaatcgtcactaataacgacaaagactacgtcacaacgcgtgtttcgtacaaacttaacctgcaagggccgagtattaacgtccagactgcttgttcgacatcgatggtcgctgtggtgatgggcatcaatagtttactgaatagagaaagtgatctggtaattgcagggggcgtttccatcgatatacccgagcgcagaggttacccctatatgcagggcggtatggaatcggctgatggccgctgttatgcatttgactctcgggcgaatggcactgtatttagccgaggtgccggggtcgttgtgttgaaacgactaaaagatgcagtaaatgatggtgatcatatttatgcagtgctgaaaggcggcgcaattaataacgacggaaatacgaaagtcggctataccgcacccagtatccaagggcagatcgcagtggctaaacaagcgattattaacgcgcagatagaaccggtaaccatcagttttgtggaagctcatggcacggcaacgacattgggagacccaatagaatttacttcattgagccaaacttttcgggaattcacagataaaactcagttttgtcgtatggggtcagttaagaccaatattggccacactgatgccgcttctggcatagccagtttgattaaggcttctcttgctctggaaaatgggaagttacccgcttcattacattatatgtcaccgaatccccacattgacttcgagactagcccgtttgtgatgaatactaagctgcatatactggaagcatctgatatacctcatcgtgctttagtgaattcattcggtgtggggggaacgaatgcctgtgttattcttgaaagcgcacctgacacaattcctggtgatccgtatgaaggcctgataatgttgcctttctctgccaaaagtgccgctgcactggaaatgatgaaacagcgtatgtgtgattatctgaaaaatcacgaagagattaatttatctgatgtcgcttataccttacaaattggccgtaaacacttttctcacagcacagtactgataggaaataatcgtaataaattattggagaaacttgaacaaccctccccgataattcacttaccagaaaaatcgtctaagtccgtggtatttatgttcccgggacaaggtaatcaatatataaatatggcccatgatctttatattacctacagtgtgtttagggaaatcatggtttattgttgtcaatatctggagccaattcttgggctgaatctacaatccattattttccagaaagaaaacagttctgaaaaagaacgtatcaatgaaactcaatttactcaacctgcattgttcgttgtggaatatagtctggcgcaattatggatctcttggggcatcaaaccagatgtaatgattggtcacagtgtcggagaatatgttgctgcctgtatttctggcgtgttctcactggaagatgccttaaaggcaatagcattaaggggaaaacttgtacaagggttaccgacaggcagtatgctggcagtactgatggatgagaaggctctgagtgcccaaatacaaggctacaaattggaaattgctgctgtcaattatcccggcctgtgtgtcgtggcaggagagacagacgaaaccgtacgtttccagaagcagttggaagataacaatatattttgcaaaccattggatacttcacatgggttccattcttatatgatggaacccatactccctgcgttcaaagaaatcattgataatattgatttacattcaccacgcattccatttatttcgacggtaactggcgaatggatgacggattcattagctaaagacagtaactactgggtcagacatgtacgtaatcctgtattgttctcccatgcgttcaacacactgataaccaaagacgatccggattttatttttcttgaagtcggccctggtcgttctctggaatcagcggccaggcaacatatcaaatcacagagtggcgttttcatttattcttcgctacccattgcaaaagatattacgacgactggggagtccttgctcatggcattaggtaatttgtgggcttgtggtattaccgttgcttgggagggtttttacaccggaaaacgccgtttacgtctgcctctgccgggttatccttttgaacgcaaggaattcaaattacctgacattaaccataaccagaatggtgctggcacatacgatacccagtcagttaatgcccgtaaacgtaagaaagccgatattggtgattggttctatatcccaaggtggaagcaaactattcctgccaaatttatggaaagtaaatttattaatcctgagacggaatgctggttactgtttgtcgacgaaatgggggttgctgaacatattcaacggcaattaacaaattcggggcataaggtgctgactgtttgtcaggggcatcaataccaagaaaaccacgactcaggaagctatgttatttcaccagaaactcatgggaattatattcttcttttacaaagcattaaggcgcaaggtttacggccaacccgtattgttaatctatggaacctatcaccagagatagtagaaccccagtttctggattattgtgattcattatatataaataccttttacagcccgctttacctacagcaagcattaatcagtgaaaatttgttggaaaatttacatttactgtttgtaacaaacaatattttcagtattactgatgaaaaactctattcaccggaaaaagccttgcttattgggcctgcaagggtgttttatcatgaatatcctgaagtgcagtgtcatctggtggatatagaggtatttagcgatatatcgacagagaatattgcccaatacctgattgcagaaagtcatatcttaactcatggtagtcttgtggcttaccgaggttgtaatcgctgggaagaggattatcaggcaatccacttaacgcaacataatgccgatcagacaatcacactgaaagatgatggcgtgtatcttattacaggaggtttagggggattgggggcattagtggcgggttatttgtctgaaattagcaatgcgacattgatcctgacttatttaacgggtttaccagccagaaatgaatggcaatcttggctgcaatcgcacccgattgacgatccaaccagtaagaagattgctgcgatcttgtctttggaagataacggtaatcaagtgcatcttgctcaggttgatatttgtgattacagcggtatgtgcgatctgttgtcacaattttcacaaattgatggtgtatttcatacagcgggtattgctggtggcggaattatcccactgaaagataaggcagattgtgcccgcgtgttgaaccctaaggtgtctggcagtttaatcttgcatgagcttctgaaagataaacagcctgatttctttattatgttttcctctattacttccattgctggtgatgctggccgtatcgattattgttctggaaatgcatttatggatgcctttgctcactatcgtaaccagtatcataaaggtcgtaccgtttccattaattgggggagatggggagatgtgggaatggcagtgaattggagcaatcagaaaaaagaccgtaaagatacaatacaagaaaaagtcaacagcgagctattggtattagtgaaacgtgaagggttgcaagaaatctacagggttaatcttaccgtagaagattgggtgattaacgaacatcgattaatacagcagcctacattggtgggaacaactgtcctgtccttactgcacgattggataacccactgcaaatcgggcgaaagtttgcaggtaaaaagcctgtttttgacacagccactcatttaccacaatggttggccacgattagtgaacctctttgttatatttgaaaataatagctataaattcagcctgaaaagccggggtgtattagataaacagtggcaagaacatgcattgggcgtgatcggtttaagtgacaatgtttctgatcaggcagcagagtcattggatactatacgcactcgctgtacaaccaaaattccattccatccattaaaagcctatttagatacggttggactcctttctttaagtcatcgttggaataaccatcaggaaatgtttcagggagataataatgaatggttaatacacatagtgctggatcctgcatattcgggtgattttatacgttatcaatatcacccggctatcatcgatgccgcatcgattcgcggtataatcaacgtcaccaaagatgagtttctgcctatcagttacggcaacgtaacctactactcctcattaagcccggattgctatgcgcatgttaaattgaaaggggcttatcaacctcaagatccctctattgtcatggatgttattttcttctcaacagagggtagcccgttgttgaagttggaaaagtatacgcttatcaaactatctccagataatttgtcggcagagtctggttatgtgttgaccaataaggaagatactttacccgtaaaagttaacctagcagataaagatatcctgttttatgaaggacttgatgcgttaaaacgccagtttttacatctggaatttggccagttggttgtggtaaccagtgatattcatcagctgattgatgagtcagtcccagagcataacgataatattgttgaaacgctaagtgagacagaaaggaatatacatactaggcctgcgttatcagtggagtgtgtggagccggaaaatgatattgaaagagaaattgttaagatttggcaattgactctcggtatttatggaatcggtgtagatgataatttcactgagcttggcggtaattctctgttagcggtacaaattatatcggcagtgtctaatgtcttcgaaatcgatattagtgttgatcttttctatcaagatcaaactgtaagaggtttatcagaactgataatttctgaattggaagagttattacgggataaataaatcggttcaggctaccaccagtgtacatctaatggaaaagtaaatctggtacagacatttaatcagacaggggcggataggagtatggctaatatcaagcacaccgaactaaagtcattgaaattagatgaattaaaaagattggtcagacagaaaaagataaaagataattcaattccaaaggaaaccattaagaaaaatactgatccggacagaaaatattttcctgtgaccagtgcacaaaaaaatatttggatgcttaaccaatatcttgatgataaaaaagtttatagccttccgttagccattacatgtcaacttaaatatgaggtagatctactgttagttaagcaggcactcacgtatttagctcaaaagcatgatattttgcgtacaactttccacctgacaggaaaggaactatgtcaatatgtctctgatgatgctgtatttgattttcgttatgatgacattacctatttgtcggaaagagataaaaaacgacaagtagaagcaatggctaaagcagaaggaaataggtgctttgatttagccggtggccctttagcctatttgtatattgttagaactaatagtcatgaatacgtatttttactgagcttccaccatattattgctgatggttggacagttgggctgtttttaaaagagtttatagaaacgtatttaagtctgcttagcggagaaataacactgaaggcagaagaaaatctacagttctcagattatgctctggctgaagatcagtggcatgctgaaggaaaatatcaacaagggctggaatactgggctaaaaagctgggtaatgtgcaaggcatactgaatattgcaactgatcgacctcgtccctccaaaatgaatacggcggggaggataatgagtctgttttttgatggtgacttttgccaacgtttgcaaacttgtgcagtacagtataacgcaactcagttccacgttattctggccgcttatgagattttgctgtacaaatatagcgggcaacaggaaatcagtattggtattcctttcgctaatcgtaatcaatctgccacacaaaacataatggggttgttcatgaataccttaccattgtgtttcagaatagatccagaaatcacattatctactttagttcaaataaccgctaaagagtgtgagcagtcgatggtttatcaggatattccattcaaccacattttggataaaattgcttacgtacgtaatccccaagttaatccgatatttcaggcaatcttaacctatcagatattcccacattaccaagcaacctctttatttaaataccaaccactgaaaattgattacggcgtggcaaagctagatttaaacctatgggtagaaaaagaacgcgacggtttgttgtttaccatgaactatagtacggcgctgttcaacggtgacacgatccaacgtatgctggcagatttacgcactatccttgacgcttttatagggcaacccaagttggcagtacgagagttgtcgctattaagccacacggaacgcacaagtttattggctggttgtcaccctacacctgatatttcacccgccgcggtacaccaacagtttgagcagcaagcatgcttaattcccaatgcaatagcggtgcgttgtaccggccgtacactcagttataaacaactcaatcagcaagcgaaccgtttggctcattatttattggagaagggtttatcttgtggagaacgtgtagcgttattaatggcaaaaagtgaagattgtgtcgtggctttgttggcggtgttgaaggcggggggatgttatgtgcctgttgatattaatcttccacagcagcaggttgattttatcctgactaatgcttctgtacgttatgttttggttgaaagtgaagaacgggttacaaacgtaccgtgtatcaacgttaatcaaaaatttaatggcatgccagaaagtaatccacagcgacaggaaccaccggaggatactccagcctatattatttatacttcaggcagtagcagtaagccgaaaggtgtccaagttaaccattcccatttaagtcactactgtcaggcaatcactcctgttcttgatcaacagccaggagcccgatatggcatgttttcatcctttactaccgatttggcacatacgatgttgtttcctgcactggttaaccaagggcaattagagattattcattcacaacatctcagtaatccacaggaactgtttgattatttagcagcgtcaccattggactgtatgaaaattacaccaacacatttggccgcattattgggaacacctgaagcgagcaaactgataccgaaaaatttgctggtattgggcggggaaaaagtgcccgtgtcgttgattcaacctattcgtgaattcaatgcgaattgccgcatcgtcaatcattatggtccgactgaatgcacagtcggagtgacgacatataacttacccgctgaacttgatagattagaaagtgattatcttcctataggtacgccattgacggatagccatgtccttgtgttagatgctaatcaaaaacttgtacccgctaaagtacccggtgaaatttatattggcggtgcgcatttggcggccgggtatattgatcgtacagaaaaaaatagcgattgctttatcccacatccttatcttgctggtgagcgcctctatcgtagcggtgacaaaggacgtctgttgccagacggaaatattgaatttttgggacgcatcgaccgccaagtcaaagttcgtgggtatcgtgttgaattaaccgccattgaagatgtgttacggcagtttcctgaggtgactaatgccgccgtaatccaatctcagtcgcctacaggagcaacatcgctggtggcttatctgtgcggagtaggggaaagatatcaagctaccgtgcaatctgagttacaaaaaaaactaccccattatatgcaaccagaacagtggatctggttggaatctctgccgcttacttttagtggaaaaatcaattataccgcattaccacgcctgagacccgatactcaccagtgtacacaagagctaaaaagtaaaacagaacatcgactacatgatatttattgtacagtcctcgaatgtaacaaggttgatacccagaaaagttttttcagccttggggggaattctattaatgcattacaactgattattgaagtaaatcaccaatttgattcttgtttatcactagggcaactatttgaaaacagcagtattagccaactggcaactttattagaacagactgctccctcgatggcttcgccattagtgatgtttaattatggtcttccagacaataaaccaaccttactgatgatccacccggcagggggtaatattttgtgttatcacccgttagtgcgggaaatgggggctgattatccggcatatggtctacaggtagcaaactttagtcaggatgccccttataaccatgatatcaaatcactggccgaattttatctgactcaatctggaagtcttctccagcgaacaagattggtattagggggatggtcgcttggagcaacgatcgcttttgaaatggctcagcagttagttcagaagacaggggtagcgcctacggtgctggtactggatcaacccgcacctcaagtaaacattgataattcagtacaaatgaataaagacgagagattagtgcgttttgtacgtaaggtggagctgtttctcggtacgtcacttaatatctcctgttcagtgttagcggaaatgtcagaggtacaaagatcagaactattcctgacagaattcaaacgggttcatttagtgccagataatatcagcaacagggaattccagtatttcttagtcattctgcgtgcacatattcatgctacagatcaatatcaagggaaaatctaccctggaaaaattttggtagtagaagcagaagaaactctacccggacgcataaaactggatgagtcaggattaggctggcaaccattgtcttatgatcgtttaaaaatcatcaatgcgatgggcaatcatgtttccatgatgcaagagccctatatcactcatattgctaaccagcttcgggaagttcttccatgaggagtgaggttataacaatggggtcagaacgatctcaactgactcgccgtcaatggtgtgctatttctggtgggttaatgggtggttttatggctattttggatattcagatcaccaattcatcaatgaacgtgattcaaggtgcattatccgcgagtctggatgaaagctcatggttgatgacttcatattttacatctgagatcgttgctatcccactatgtggttggctttgtcaggcactgggaaccgggcgctatgctctgtggtgcattagcggatttttaggagcatcactgctttgttcctccgcttggagcctcaattcaatgattgtttttcgttcattacaaggattttgcggtggggcattaattcccatttcattccgtctgattattgaattttttccaccggaaaagcgcccgttaggtatgtcattattcagtatcatcagcacctttgctcctgcggttgggcctgcattaggggggtggttgaccgaaaatttatcctggcacgcgatattttatatcaacgcaatccctgcgttattatcatgggtattaattaactattctctaaaacatcaatcaattaactggaatattattcgatttggtgattttgttggtattatttctatcatgttgtgtttagggacattaatcgtcattttggaaaaagggagtgcggaaaattggcttgaatctgacatgatttgtgtattagccgtgatttctaccattagtttcattatatttctgtatgatcaattgacttatcgttacccactaataaatattaaattatttaaggattactatttttcattttctctcatcatttttgccctgtttggattggcaatttatggtacgttatttctagtgccgtattatctgacaatgacacagagttataatgcctcagaaattggtagggtagtgatttggatgggattgccacaattaattattcttccatttattccttttttgatgcaacgattcaatctaaagtatttgatctgcattggctttgccggattggcgttgagtgcttttatggactgtagtatggatggaaactttgctggatcacagatgagtgggtctatgctgatacgtgctctgggacaaccgtttatcatggttccactttctttgttagcgacccgccatgtacagcaaaaggacagtgcttcctctgccgtcctaataaatgtctttcgtagtttgggtggatcatgtggtactgctatattgaccacatttttcatttcgcgtattaacatccatattgataatattaaaacatcgctactatctagtagcagtgcatttattaattatcttaacaatgttaaaagcctgctgattcagcatggtttggcaactgatactcagagtgtgaaacatacagctatcactatcttgggtcagcggatagcgaggcaagctgaaattatggctttcaacgatctgtttttaatcatgggaggaataatgttggtcacaacgttgttggtattgttttctacccatgacttttacttatatttaactaggaagaaatcataatgaatcaacaaaaaccaatgactatttggcattacttattatcacgtgatgcgctaatgactattattatccccattgtactttacaacatcatattttggataatgggtacaggtattgctgtgttgatggttgcgctttattcggggggcgtgcagttatttagcagacggagaggatctttagctattatcgccctaattatggtttcaggggtgagtcactacctttaccttcatggatatgctttgtttaacattagtaaagaaaatgtctttttatctatcagtggtgctctttctgtcgtggtggtattcagcttttattccttcatggggcaacccgttgtacaaacaatggctgaacaagctatgccgagactgaaggatattcctgcttatggtacagcgttgtatgccagagtttggcatgaagtttccatagtctggattttagtttttttattgaaagctttcggggtctatatgctttcatgtcaaaatagcgtgtctattgatacaattatttttattggtggttggccattaacattgctgatggtaatgtttagtttccgttggccaaaatatcgttggaaatccaatgcccataataaagagtaaacgatatcttattcatccagaatacctgattaatataatcgacatttagcttattggaaataattatgatgaaatacattagagtaattatcattatttttttatcgttgctagttctttatttatattggtatttttattggcgttattttcagacaacaaataatgcttatgtacagacaaatattacacatattaatgctcgtgtaagttccgtagtattggaatccaatattcaggataaccataaagtaaaaaaaggcgactttttggtacaactggatgagcgtgaatttatgctcaataaacaaaaaacggcggcggcattggaacagaatgaaaatgccttaattaatgcacaagcaagctaccaaatgcagaagaatgtgattgaagaacatcgtagtagtttgatttcggctaaagcaagtctgaaatatgcacgccaacaattagatcgttatcagcttctaaaagaaaaacgttatgtctctcaaagtgatgtggataatgttatctcgaactacaaaattgctgagtctagatatggtgaagcacaggcaaaattaaaaacacaaattagcaaacttgttgtgcaagacagccagctcaaacaagccaaagccaatgtacaacaggcgatggcttcgctaaaccaagcagaacttatgttgagttatacacgaatagctgcacccaatgatggagtgatcagtaaccgtagtgtacaagttggtacgatggtacaagctggacaaggcattgccagcattgtatcgaatcaaacgtcatggatacaagccaactttaaggaaacgcaaatttcacgtatgcataaaggccagccagtaaaagtttctattgatgcttacccggataaaattttccacgcaaaaatagacagtatttcacctgcaacaggggctatttttgccttacttcccccaaataacgcgacaggaaattttacaagggtagtgcagcgattatcggtaaagattgtgtttgaccagtcagaagaaattgatagtgggttatctgctacggtaacggtggatacccgttaatgtcggtagttccggctgacattctccttagcggcgtttcggtgttgccctgcttaaagcgggcgaagatgctcgtgatgcttcgctgctccataccctcctgtaggtttgccagcttcgttgggcaaacaaaaaaagcggtgccactgacaccgctacaatctgtacagaacttattatttcttgtctgctgcgatacgatcacgaacgtgttgagcacgctcctgtgaaggcggatgtgaatcaaacatgctggctttaccactgcccagtttagccagtttctcgaagctggttactaaacctccagtgttgatactgcgttttttcagcagatcataagagaagtcatcagcctgactttcctgatgctgtgagaactgcgagttgatcagtttttcacccagtgctgcaaattgagaatcgctcagctgtgctgctacaccaccggctgatgtagctgcggtacgtgcagcaactgtcgcataagcaatctgcattgctttacgggagtgacccagtgcaacgtgacccatttcatggcccagaacgccttcgacttcattgtcgttcatcatgttcatcaggccgctgtatacacgcacacaaccgttagccattgcccatgcgttcacatcatcagtcagataaactttatagttaaccggtgtaccgttaacttcgctacctaatgctttggcgattttgttcagacgtttagtgtattggctggatgccggtgcagttttattctgtgcatccatatccttacatgcttggtcagataactgtttgacatcagaatcacttagcgtcgccgcctggaataattgcattccggagttagccagcattccttgatcaatattcttacaacctgtcaaaattacagcagaaactgctactgcaacaagagttttaattttcataatgttgtttttccctttgccatacaagcaacttttttattttaaaagcattaaaagaccgtggattctgctaaaaataataatagaaataaacctaatatttatgattatgtgaatttgataacattttaaacaaaataatcatatcatttaccattcatagggagacatcagggcgggattttactttgcttaaaaattaatctttaggagcttgtacgtaaaatatgatgtaatttcttggataagatggtgaaaattttacgtatagatacgttttttggctataaaagaatcgattttaaagtggaatcccgccctgtcttatgaccttttcccctacaaacgggtcatcacaccttgaatatacagctatatgatcatcatcattgttataatgagataaaagtccactatatgtagcaggacaaagaactttacctccgctttcatataaattgacaaatggatttttcttgattttcaaaaatggtaaatcttttagccatgaatcccgtattgtgacatcgtcattggcccaccagttaccattaaaatactcattttcatctaaatgattaaataaaaagggtgtggtgattgaaaaaatctccttggctttatttgtgagaaataaagcgccatattcagagtaaagtgactttctatagtcattgttacttttttcactggatatccttgacatcgtttttttataatctttttaaacctttcgtttccctttgactggaggtttatttcaatgtcatgttcattaaatccagcatcttccaacagtgaaacatactcttttggaataaactgacatttatcttcagatttaattttttcatatatagcatatctttcttcattgcctccacttattccggaaagatcagaaagatagaggttcaacattgcttttttatttaattgtctaaggctggatacaagatttattcctgttctgaaggagagtaattccccttcgctacagtttccctttaaaccgaaacggtattttttacttgttccagatatgatgatatgaccgcagtcaacaacaacactattcctaagtttttccagtaaagggaatgttctttccatctattaagtttcctttttataaactagagttaagcttaaatattctgcatctgatgaagtttctataaataccgtatgggcgtcccaccatgccggcaatgaaagcaaagaaaagaatacttttaatcatctgttctaaagaagccccactaatcgtaagattggtaatatataaaggcatctcaaatgaaagataggctaaagtatcaaccaggtaaggttttattcctttgtcctcattagaaattttgaattttttgaaaacccaatctcgccaaataccaaaaggtctggcagttgtcgtaatgatgaaaagtccaataaaacgggtatgcaaatatatcagaaagaaaatttatttttcttttattgtgaggttgagttgctttttcttccatgtttttattcctccactattttaaaatacattaataagctggttgtggttttacaagtgaggttattggttacaataactgtatttttgtaatattattaacccggcggcaatctatgtcgtcacagatcccagggcgggattccactttaagatcgattcttttatagccaaaaaacgtatctctacgtaaaattttcaccattttatccaagaaatcacatcatattttacgtacaagctcctaaagattaatttttaagcaaagtaaaatcccgccctgtcacagatccagagtttatgcggcttgcagctacataaactccgatctaaatcaccaccaggttaataagtcgattattttaataatcgacttattaaatgaattataatattccaacacttaatacaattaaataagtccgtggaccaaaatcactccgatacataaaggtccgacatatctccatataaatagtaaacactgacggttccacgatgacatattatccggtattagtgcattgaccttacgtgaccagccaaatacgaggcaaatgataatcccgaacaatggcataagaacattggaagtaataaagtccagcatgtcgaagatggattttccacctaatgtgacgtgacttagcgggccaaaagataaggaaacaggaatccccattaacataatcgatgccgtgacgattaagcttgctttacgacgcgaccactgaaaacgcgtctgaacataagcaacaatgtgctcaagtaatgaaattgatgaggttagtgcggccattaataacagtaaaaagaaagtgactgctaagattgagccaccaggaagattggcgaaataaattggcatcgtcataaacgttaagccgggtcccgcatttggttttaaaccagcagctgccaaagcaggaaaaatcatcaggccagccaatatacagaccaaacaggagaggattacaacccagatactcgatttaccaatacctttgttattaggcaaataggagctgtacgtaatgtgaattcccaaaccgatagacagtgaaaaaaatgccaaccctaatgcatctaaaacaccttttccggtcaagctactgaagtctgggtataagaataattttagcccttctgatgaaccaggtaaacggatgccgacaataattaacacgatcatgatcaaaaataacagtggcatcatgaccttaactgatttttccaaacctttttgcacaccagataatactacgaaacaggttagccctgaaaatatcagatgtgcgattatcggccaccatggatcgctgatgaaattggtgaaaatagatgtcagttgagagatgtctgtaatattcaactttcctgtactcgccatcaccgtgtaacctatggtccaaccaccgacaacactgtagaagctatagatacaccatgaactgaatatacctataaaaccaacccacccccagtgtttaccaagtaattttttaaacgcattaatggccacttcacccgtactgcttcccagtatgttttcagctaacagaatcgctaatccaatcacaaagctaaataataaaaatacaaccaaaaatgcaccgccaccatttgttgctgaaacatacgagaatttccagatggcaccaatgccaacggcagatccggttgctgctaatacgtgccccagacgggatgtccattgttgactcatgctaacccccgaatagatacagtgtcagcacatgtacttaggcccacagccgtaagcaaaaaaccagcagcattcgaaacatgcttacccgcttgcaggccaatcataggcggggaaatgatatttcctgccccgatgaatagggcaaaggtcataaagcccaatgcccaaatatttttagatgataaacggtatgtcataataattgttaacttattgttgtaaaaataattgaacatgtaatagtaactattacaactattttaatttccactgacgaaactggattctgatttaacagtcagtgataagtatcatattcactgatacgcataagatacagaatgatagtggtaataacagctagaatcgccaacaactgctcacaagtaaaacttttaagtgctaaaaggcatgcaccaacgccttgtgaggtgtccaagattattactccattacagctgatcatgttgctcacagttaatgctactaaatgatcagcactatgtagtcgtgaacataaattccaataaacttgatcaatatatatagttattgtgttattttttatttaaccattttattaaatatttctttagataattattctgtaaaattagaatgtaattctaatatatgatcgttttcaaacaaaaaatattttatattttagtcggtcatttttatccgttctaataatttctctatatttacgcacctgattttatttgaaatataatggctactatagccatttttgctaataatatagatattaaaaaatctatgatttatttatttttggttattattattgataagactagagcagataaaattgacaaaattacaattccaaatgtaaccactaatacagattttaatttttcttcattatttaatgatgatgtcatcacgtagaaaaaatttggccaagaagaaagaggagccaaaaaatgaacaaatattaaggttgcaatcattttttaatatgcgtcaatagtggtagtgataacttattttaatcatcgcaataaacttttgtcaattaatatttgtttgcatattaaaataaaatatttgatacatttgtaataataacattttttattaattagtaagggattgatttacggttaattatatgtgttctttcagggaggaatgatattttaggtgttcaactttgttacccgatttcctatgttccacttgtacaagtggggtaactgtaaatcctaatattcgtgagaaatttttgttctctttcatcaccttataaaataattctgagttacaccgtgtattcagataatggatgcttatctttatctgatagataattatctctaccaatccgaaatctttctgatctttacaaggtatcttggattgtattggtgtaactattttcagtaataccaaatataggtattactgaaagctgaaatgaaaattaccttcatggttaagcaggttatttaacaccgttagtttttttgactgttactctaattattttgatttatattatggctaggattttattttccattaatctgtgtatttttagcagggtgggggtcatgtattgaatagttagttattgtgatatgctctaactttttaagggtggatcatggctaaagttgatgtttattgtcgttattatcacatatcagaacttgtcaaagggcatggaaaaggaaatggtggccatcgctgttatgcctgctgtaaggtctttcagttggaatacacctatcaagcctgcaaacccggtgttaaagagcagattatcaatatggcaatgaataacggcgggatccgcgacaccgcccgtgtcctgcaagtggccacaagcaccgtcatgacaacgctaaaaaactcatcccccgaaacgtgacgacgcttcttcttgacggggataacattcatcttacctgtgaaatggatgagcagtggtcatttgtggggaacaagaaaaatcaacgcgggctctggtatgcttgggaaccctgtctgaaacgaatagtggcgcatgtttttggggatcgcagccgaaaaacactagacaaactgcttgcccttttatcgcctttaatactcggttttattgtacggatgattatgctgtgtatgaccgcctcccagaggaagaacacctgactgggaagacattcacccaacgttgagaaagaaataatttaacgcatcgaacccggataaaaagactgaatcgcaaaacgatagggtattctaaatcggcggaaatgcacgataaagtgattggcactttcattgaacgtgagaactatttttaataaacgatctaactatttaatacacgatccgtagcggcgcctataccagctccccaagctacattttctgttagtttattcaatgaatcaccagccccggatataattgttaattcatttggtaatagctctttcatttatcattatcctatatatgtaaagtattatcagatttatgaacatagatatcgcggcagataataaacaaaaaataataaacttgtcaaaataaaaatatttttcagtaatgaaaatgttagtaaatggataaacaaaacaaatagaaaaagaaattatcaccaaggcaattatatttacggtaatgctagatttattttcattaacatgtatgaagataataaaactaataaaagatagccaaataggagagaatgaaaaagaaataaatgacatagataatccttatgaatgtattttacacataatacacgttgatatttttttgtgcaaaaaaataataaattcttaatttaccctaattctggataagaaattgacgtaaagcctgttccaggaacaatgttttggtgcatgccgaaacagtgagagcataaaaaagcttggggcacttatgcgataaagccgctaaagaagtctcgcctgacaacttgaatcgccgccagaccataggactgataccctgaatgcgctataagttaaagcacgatatgtctgatgaggtataatcaagtcacttttttatgtcattttccgggtatcaatcatgtctgacactaatttttctcaaacggctgcttttatctggtcggttgctgacctgcttcgcggtgattttaagcaatcccagtatgggcgtgtgatcctgccttttacgctgctgcgtcgtcttgagtgcgtgttagccgccactaaagatgccgtggtagccgaggctgaaaaactgaaaaccagcttgctgccagaagaagcaaaagagaaatttctgctccgtgccagcggcctgacattcttcaactcctctccgatggatctcggaaagatggggcaaaacgatatcaaggacaacctggagaactacatccagtctttctcaaaggatgcgcgtgaaatcttcggacactttaatttcagtgagtttgtcagccttctgcaggatgccaacctactgtacaaagtggtgaaaaaatttgccactactgatctcagccccaaaaaaatctctaaccatgacatgggcatggtgtttgaagagttaatccgccgctttgcagaaagctcaaacgagacggcgggggagcactttaccccgcgcgatatcgtacgtttaaccacctcgctggtatttatggaggatgatgaagctttatcgaaagacggcattatccgcaccatttacgacccaaccgcaggaacgggggggtttctctcttccggcatggaatacgtgcatgaactgaatcctaacgcggtgatgcgtgcttttggtcaggaattaaacccggaatcctacgccatctgtaaagccgatatgctgatcaaagggcaggacgtcagccgcatcaaactgggcaacaccctttccaacgaccagttaccactggaccagttcgactacatgctgtctaacccgccgtttggcgtggactggaagaagattgaaggcgagatcaacaacgagcatcagcagaagggttttaacggccgttttggtccaggtctgccgcgtgtctctgatggctcgctgctgtttctactgcatctcatcagcaaaatgcgcgacagccataatgtggatggtaccgtgactaatggtgggcgtatcggaattatcctcaacggctcaccgttgtttaccggtggtgcaggtagcggtgaaagtgaaatccgtcgctatatcctggaagctgatttgctggaaggcatcgtcgcgctgccgaccgatatgttctacaacaccggtattgcgacctacgtctggatcctgtcgaataagaaatcgtcagaacgtaaaggcaaagtgcaactgattgatggtacaaacctgtgcggcaagatgcgtaaatcgctgggttctaaacgtaacctgatgggtgaagatgatattaaactcatcacccgtacctttggtaattttgaggtggtgaatgccacgccgctgcaagaattaggtctggagaaagccgcagagcaaaaatctaaccgtggtcgtcagtctgccacggcaaaagtcgaagcgccgaaaaccttcgccagcaaaatttttaacagcaccgactttggctatcgccgtctgaccattgaacgcccgctgcgtttgtctgcacaagtgactgatgaagtgattgcaaccctgcgttttgcgccgaagccatttaacgcgccgatggaacgtctgtatgaagagttcgtcacacagtggcaggacgataactatggcgatttcgcagagatcgaagcggaagctcgcacaatcatcaaagcggaatttgccgagctgaaagagaagcaaattaaagacctgctcgatagcaagctatggctggcacagcgcacgttaatggagaaagcgcagcagattcaaaccgcattgggtgtgcaggcgggtggtaagacgcaggtcagcgacgacttcaaccattttcagcttactctgaaaggtgcgctgaaaactgcaggcgttaagctggataccaaagaaaacaaacagtttattggtgctatcactaccaaaaatcctgctgcagagccggttgtgaaaaaggtactgaaagaaaccgccctgccgctgtatggtgcttttgagtacaaaggcaaagtggtggagtttgatcaggatggcgacctgcgtgataacgagaacgtgccgctgaatccgtctgtctccaccagcgatctgatcgagaactacttcaaagcggaagtgctgccgcatgtggttgatgcctggattaataccgataagcgcgatgagaaagacggtgaggtggggattgtcggctatgagattccttttaaccgccatttctacgtttaccagcctccacgtccgctggaagagattgatgctgatttggatgcggtaagtgctgaaattatgaaactgctgcaggaggtacattcctgatggctgggttaaataaatataaggcgtatccggaatataaggactctggggttgagtggctgggggagattcctaagcattgggctgtttgtagattaaaaaatctggcaacaataaaaaatggtcaggattataagtctgttcaagcagagtgtggctaccctgtgatagggtctggtggacaatttatgtttgcatcaaaatatatgtatgataaaccatctgtactgcttgggcgtaaggggactatagataaaccattatatataaatgagccattttggaccgttgatacaatgtattacactgaattaaacgatgatgtggatgcaaagtatttttattatctggctctcacaatacaattttcacgctactcaacaaatactgcgttgccaagtatgacgcaggagcatttgagtaattataaattcgcagctccaaaggttgaatcagatcgtaagcagatcactgattttctggatcacgaaaccgcaaaaatcgataacctgatcgagaagcaacagcaactgatcaatctgctgaaagaaaaacgtcaggcagtgattagccatgccgtaaccaaagggctaaaccctgatgtgccgatgaaagattctggtgttaaatggttgggggaagtgccggaacattggattgtcagcccaattaaacatgtgcttgctaaccaagactttagaaggattccgttgagcagtgaagaaagaggtaaacgtagtggtgaatatccttactacggtgcgtcgggtattattgattatatagataattatatttttgatgaaccaactgttttagttggtgaggatggtgctaatttggttgcacgcaacacatctcttgcattttctgctgttggtgagtattgggtaaataatcatgctcatatactaaagccgtatgatggtctggtcgactattgggcagaggcgatcgaacatatagatattaatccaattgtaagtggttctgcgcaacctaaacttacagcagaggcgcttaataatttgaaaattgcttactcgccacaattagaagaacgcagccagattgaaggttgtatcaatgttcaaaagaataaatataaaaagctaatcagtattgcggcggaacaagttattctacttcaagagcgccgcaccgctcttatctccgccgctgtcaccggtaaaatcgatgtacgcaactgggtagcaccagacatgtcagacattgaggagtcacaggaggccgccgcatgagtatggataccaccaaagagctggttttccagaatgaaatgattgctcagatggtcgatagaggctggattgttggcaaaagtgacggctatgaccgcgaacgtgccttgtacttgcaagatgcactggctttcgttcagacgacgcagccgcaggaatgggagaaattttcgaagatttatcccaccgatacagaacgtcatttcctcgatgcactggtggcgcaactgaaaaaagcagatatcaacgccaccgatatgctgtcgcgcacttacgggacgctgggggtattgcgccacggcatcaaaagtcataacgcccgtttttctctgtgccagtttaagccggagcataacctcaatccagaaacccttgcgcgatataaacagaacatctgccgcattgtgccggagctggtttatagccctcatgcctcgaaagcagcatttgaagaatctggcgtaaaagcgaagaaatggcgtatcgatttggtgctgtttgtgaacggcctgccagtggcgacgcttgagttgaagtccgagtttaagcaggcggtgcaaaatgcgatcaaacaatataagaaaacgcgtttgccgaaagatcctggcaccaacaaacctgagccactgctcaccttcaaacgcggtgctctggtgcacttcgccgtcagccagtatgaagtgtttatggcgaccaaacttgatggcgataaaacctttttcctgcccttcaacaaagggactaaagatggtggcgcggggaacgatatcccggaagatgaaaatgaatacgccaccaactacctgtggaatgaagtgcttctcccggacaatctgctaaatattcttgcaaattttgtacatctgcaaatcgaagagaaagaagagtggaatggcctgaaaggcaagaaagaaagcctgatcttcccgcgttatcaccagtgggatgtggtgaataaattgatcactgctgctgcgattgaaggcaccggtaataagtatctgattcagcacagtgcgggttccggtaaatctaactcgattgcctggaccgtccaccagctttcccggctgtatgatgagaaaggcgagaagcagttccattcggtgattgtggtgacggaccgtaccgtactggacgatcagcttcaggacaccatttatcagtttgagcatcaggatggtgtggttggacgcatcaacaataaagaaggcgatggttcgaagtctgaaaagctcgccagcgcgctggaaaactcgcagccgattattatcgtcaccattcagaccttcccgtttgtgctgaaggcgattgaaaatagtgtcagcctcaaacagcgtaaatatgcggtgattgccgacgaagcccactcttcacaaagcggctctacggcacgtcagcttaaagaagtgctgatgaccgacgaagcggatgacgatgtagtgctgtcttctgaagatattctggatgccaccgtcgccgcacgtaaaggtagtaataatcttaactactatgcgtttaccgcgacgccgaaggccaaaacgctggaactgtttggtcgtctccccaatccgcttgaacctgcgtcaaaaaccaatatgcccaaagcgttccatgtctactctatgcgtcaggctattgaagaaggctttatccttgatgtcctgaagaactacaccaactacaaggtggcctataagctcttgcagaagctggacgatccagaccgggaagtcgacagcaaaaaagcgaaggtcaaattgaatcagtgggtagcgctgcacgaacataacgtctcgcagaaagtaaaaatcattgttgagcactaccgtaagcatgtgatgcatttgctgggtgggcaagctaaagcgatggtcgttaccagctcacgtaaagcggcggtacgttataaactggcgtttgataaatacattgctgagaacagttaccagaagatcaacgcgatggtggcgttttcaggcgaagtcgaattcgttgacagcgaccacaacagcctcgcgctgctgaaccagaagtttactgaaattagtatgaaccctgggctgaagggccgggatatgcgtaaagcttttgatagtgatgactatcaggtgatgctggtggcgaataaattccagaccggttttgaccaacctaagctgtgcgccatgtatgtcgacaaagctttgggtggggtggagtgcgtgcagacactttcacggctaaatcgtacctatctgggtaaagcagaatcagggacatttgtgctcgatttctataacgagccggatgacattctggcggcattccagccttactaccaaacggcagagctgactgatgtcagcgatccacagctagtcttcgagctgtatgagaagcttcgctctagcggtattttcctgtggaacgaagttgagcaattctgcgaggcattcttcaccaaaaacaaatcaaatgcggcaataagcaacatctgtaagcctgccgttgaacgctggaaacagcgttacagctctgcgattgatgcctatgttctggcgaaagaaatgtttgaacgtaccaaaaagactggcgatgtggtgctgattactaacgcggaaaacaactttaaagcgagcaaacaggaaaaagacaaactggatatcttcaaaaaagatctcggcagctttgtccgtttctacgaatttatatcgcagatcgttgactacgatgacaaggatttagagaggctgagcctgtttgctcgtcaccttcgcccgttgctccatgagcagcgtattgaagaagatgagattgatttaagtaatgtggagatgagccattaccgtttgtcaaaacttcacgaacagcatctcaaacttcaggaagatgctgaagaatacaaaatcaaaccgggcaatgatattggtacggcgaagccaaaggataagaaagaagagtttctgtcgaatattctggtacgtctgaacgacctgtttatcactgacaatctcaccgacaaagacatgatcaattatgtctttaccgtgcgtgataagctgtcggaaaaccaggcggtgatgacgcagattgctaataacacacgcgagcaggccatgttaggtgattttcctaaagccattgatgatgcggttatggatagcaatgacgctcagcaagagatgatgatgcagtacctgtctaaccctgagctggcaaaagggtttgcacgagtggtgtttgatatgttgaaaggggcttgagtttttagttgatcagaagtggttaaactatgctgaattcattagaaatttatcatgtactgaataagttaggaataacgctggcagctgggtaatatgaacccagctatgtctctgaacatgctttagagaatggaaaatgctgaagtgatcaataaaaatgggtcactcctttagcgtttttccaaaataatcgttctgactcattcggcgttaacccattgttatactaatggggacgaagctagctgtaataaccggttatataacgggttgtttagcgaattttggtcatgacaaacaattgtttggcaaacaaggtgcgtctatgtatgcacgataaagtcattggtacattcattgaacaaaactactatattcaatatcaatcaacggattgaatgcgtgacccaaatttgtatgagtcaatgtttgaccgttattgatgcaatcgtttaatatcttttttgttatctcagtgatccctcgcctgcaaggatcacccatcggtcggcgaaataaaaactctcgtagcctgaaagggagtgtaagcattgcggtacatctgcacacttttggaagcagatatcttcggacacctaaccctccgtctgatgatgaaagtttcccggtgttattcaccacaccggctattcacccagcagggcagaacaggctctgtcttacactgaacgataccgttttcatcggtacacccttcactgacattttcaatgcatcacgataaacgtcccgaaaactgcgcggcgtcacttgtgttaaagcacagcgattaccaagtgacgccgccgggcggccaacgtccagagcacgtccgtcctgacttcacaacggatttgatccacattttactcaataaaacctctctcaaacacactatttaccgtccccgccggatccgggctcaaccaccgccccgcccggtacccgtagtagtacagtcctgtcgcatctcgctccttacccgagtaacgaacagtcttataacccgcttccgtctggttcctcgccgtccacactgctgtgcctccgtacgggtagtattcttccatactgataatttgtctgtctccgtccacctccagaccactgctgcccaccagattatcgtagctatagcgcatctgattgttactgatgtcgtccggttttccgctttcccaatgcagtacctggtttatgggcgaagcggtattaccggagcaggtcactcaccgggatgtgctgcggtggcggtatcattcgttggtggagaagaaacaatccggtcatacttggaacaataaggtggctcacctgcggacgatttttaatttcggcatggcaaggacactcctgccacagactgaaaacccgtttaacgatgccgcagtgaaaaaagagaagaaaaagaagaaaattctgagtaaatcccagatcattcatctctatctgctgatgagacaatacgaggaagaggaaagaagataagtcgctccacggggaggccgttgtatattgtacctgacagggtattggttgaccgtgttagacaccttccggttaacgggtatgcgccagaaccagttattgcacctgcggttgcaggatatcagtttggaaggcaattatattgtcctgcgtgttgaaggcagcaaaaaccacagtgaatggcgggtgccgatgatccggcagcttaaaccccggctggcgcagttggccgggcaagcaagagcctgtggtgaaaaagacgatgatccgctgtttgatttaacccgcctgcgttttcgtcatcacggacgaacaatcagttatcagtataattacgataaagaaatgcagcatatccgttctttcttcaaccggttgtctaaagagtgcggtttttccgtctcctctcaccgttttcgtcatacactggcaacggaactgatgaaagcaccagaccgtaatctgcaactggtcagaagtctgctgggacaccgcagtctggcaaccacgatggaatacattgatatcgatatggaaatcgcgggtaaaacgctggagaatgaactggcgatatatctggatatttcggtgtaaggataacatcaggtaaaaaaacagggcagatcttcgacaggattgaggaggaggtgtaagtgaacgtccctgcatcaacattgatggtatgaaaaaatggctaattccgatcctgcatcccgtgaagtcttcacctgacttgacatcagaatcaattactgaaatcattaccctgaacgaaaaaagagtgcttgcaaatgcaggcactctgtattctttatttacggcttttttaaaaattgagtatgcagactaagctaccaattgtttaacattttattaacagccctaaattttaacttatttattaatcatttgataatattcaataaattagctttaaaatcttggtgcccggactcggaatcgaaccaaggacacggggattttcaatcccctcctaagttgaaaaaatgttaacgatgtaattcttattactttgtgtaccggttctggtgcgcaaaatgataattcttcccataatttcccccaaagggggcgaaggtaaatcgacccacgcggctaatctggccggtttttttgccgatgccgatttacgtgttctcctgattgatgcggattattcgcaacccaccgccagcagtatttttcccctgaactatgaagcccccgcgggtttatatgagttactgatgcaaacggtggatctgcaccagcctgagcagatcatttcccgttcggccatcaacaatctggatgtgctgatctccaacgatccggatgaacttctgccaacggcaatgctgcacgcgcccgacgggcgtttgcgtctgcgcaatgtcctgcaacatcccctcttcagtcaatacgatattattttcattgattccaaaggggcgaccggcgtgatgagcgagctggttgtactggcggccacgcagggcgtgctgggggttatcaagcctattttacccgacgtccgcgagttcctgcgcggcaccctgcggatgctgacccggctccggccttttgaaaactacggtatccggctgccggctatccagatactggtcaacgggattgaaggaacgaatctcgaccgggatacgctgagtgaactggccgacattatcaataatcaacgttatgatgcttccgcactgggcggcaggcaggtttaccagctgctggaaacccggatagacctgctggatatctacaaactggggcatgtccgtgcccagcccgttcatcgccttgagtataaaaccacccgaaaaagcccggctgccgcgcaaaccatgcaccgcctcgcctgtgagttagtgcccttatgggcggaaaaattcgacgcggtattgactgtgcaaccgacaggagaggcgcaatgaatgttatctggcgggcggtctgctttcgttatgagcgcgttgaattactgttcagtgatgatgagtggtttgtgtttgtggatgcgccggatcgtgaaaccgcgcaggcgaaacttcagatcctgttgccagctgttcccgacgtttctccggaaagggtagagcattattatccccgtatgcgcaggcaggccatgcgccccgatgcgtttccggatttggcgttgctggaatgtggctgggaaaatgaccagccgcagtatctgacccataaagaggtgctgttctgggtttcttcccctcatctgcaacagcgtttaatcgctgccctgaatgcgatcagcagggaggtcgccgatgaatctgccgcatgaacatttacagatcatcagtgaagaggcgcccagctatgcgtatgccgaagtgggggtgttggggggtctggtactggagaatgagtgctgggatagcgttgtccagctattggctgccgacgatttttattttccggcacaccggataatatttcaggccatcgctgaactgagcgaaaaaaactgtccgttcgacctgattaccctgaccgataggctgacccagcgcgggcaaattgatcgggcatgcggttttgcttatgtagcggaagtgtgtaaaaacacgcccagtgccgccaatattgaggagtatgcccgtattgtggcggaaaaaagccggttacgtcagttactggcactggggaaatccctcagcgctgacgtttttcagccgaatattcagtcagataccctgatagagaaggcagaaagtcagttgtttaatctggctgaaaaaggttcgacccgccaacatcaggaaatgaccctgttgcagggtgcagacagcctgattgcccatctggagcgaatacaaggcgcacagggaataaccggaacaccgaccggatttcaggatcttgatgaaaaaacctgcggcttgcaggccggtgatctcattttgctggctgcccgcccttcgatgggaaaaaccgcactggggctggcctgttgtctgggtgccctgcggcaccgggatgatgcggtggtacagattttcagtctggaaatgccggcggcacaactgatgctgcgtctcaccgctatggaaggcggggtttctctgggtgccctgcgcagcgggatgctggatgatgagcagtggggacgtatcagccagagtctggatcagtttgcccgctgggatcatcgtctggtgattgatgattgcagtcaccagacgcccgcattattacgcgcccgtgcccgccgctatacccgcaaatacggtaaacccgccctgattatggttgactacctccagctgatgagtgcgcccgggcaggaaaaccggacacaggaaattgccgatatctcccgtaacctgaaagcgttaggcaaagaactgggctgcccggtactggcgctgtctcaactgaacagacaggtcgaaaaccgttccgataaacgtcctaacaatggtgacctgcgtgattccggctcactggagcaggacgccgacctgatactgcatctctatcgcgatgaagtctatcacccggacacacccgatacaggtaccgctgaaatcattattggtaagcagcgtcagggtccaacgggcgtggttcgtgtgggatttgacggccaatatacgcggttttcggacttatccgcagacagtgatggttacggggagtaaatgatggcacggcaacatctcaatatgggcaatgccctgttacaacaagggcgccaggccacggcgacactcagtgaacaaccccctgtgtcggaaatgccgatggtactgacactggatcaactccgccccaatccggataacccccgcaccagtcggaacccgcgttatgaggatatcaaggcctcgatcaaagtacgcgggctggatacggtgccgaaagtcacccgcgatccggaaggtgaagatgtctatatcttcagtgacggcggcaatacccgttatcaggttttgtccgaactgtggcaggaaaccggcgatgagcgtttttatcgtgttcactgcctgtttaaaccgtggccgggcagattgcagtgtgtcatcgggcatctggcggaaaatgaactgcgcggtgaactcagttttattgaaaaagccctgggggtctgcaaggccagaaccctttttgaagtacagaaacagcagaaaatcacccaaagtgagttgtctgcactactgggggaagccggttttcctgtcagccgcagttatatcagccggatggaagataccgtgcaatatctctatccgtggatgcctgatctgctgaactcggggctgaaggtaccccaaattcgtttgttactggcattacggcaggatgccgaggccgtctggctacaacatgttgtcagtgcaatatcggagcctgcctgttcctttgatgcgatttttggtgcctgttgccgcaaatttgactccccggaatcctggtcaccggagatgttccgggatgaacttatcggcgatttattgcaggtattgccgcacccgcagctgaattatgaccgctgggtactggaactcgatccgaaggaaagtaaccgccggcaactctttggtgaacaggccaccccggttgaccctgtgccggaaaagccggatacgcctaaagcggatcgggctcgggcgccagacagggaaccgaaccggcgcataatgtctcaacccgtcacggatgcggagcaggcatcggagacaacatgcgctccggtcgataagacacccgtgcctgctccgtcttcccgaaacaatccggtgctcccgccttatcagccggatagtccgtctgaaccggcgctgtctgagcctgaagccgacgatctccactttgcccggaccgggctggagccggtcagctcagtctggcacatttccccgatgcaggacgatatcgagcatttgcaaaatatggcgtttcgcctggcgtttgaactggccgaagtgatgggctgtgaccgtgatttgctgccggtatcggatgaacggtcggcgggattttgcctgattgacgggccggatgttcatcctttttcgtgtttattgcactccctgaccggggaaatctcgattgaccgtcatgaactgacgctgactgccgttctgctcggcaccgccggacggaaggcggtaccattactggatgacagccagaccgtgaagtttctgcggctgctgcggattatccgtcgcctgcgtgaacttcagcgcgaaattgtaccagagatattgacgatgtagcgatgccggtacggggtgcctgcttttcagtgtgttgttcattcattgtgttttgaccggcctgataatggaggaagtgtatgaatcatttatcgcaagcgaccaacagcctgctgttgcagttggtgatggatttgaagaacggctatatccgccgttgcgaagcactggggctggcaccctcggagatgctgatgttacagagcctgacgattgaggatttgcattatctgggcaacagcccggtatcggtgctgagtgtgcaaattcatcacgccaatctggcccgcatcttacatcaggcgcgtatcgaacagcagcggatacaacgcattgaccgggcactggcactcagcggatcgattgacctgatgcactatttttttggcctgtccagtctggaggtggcggcgcgccggcgtattgccggtattgccgtgaagtcggggcgggtttcggtgctgacggaagcggaaaaccgtgacctgtggcagcgctggcaggcggcaaagatgagggatgcagacagtgccgacgggctggatatcatgatggacgtggctgagcatcatgatatttcgctgacgtccgtctggaatgccgtcaaagaatggcagcaacagggtgcatccggatcggtctctgtgaaaaaacaggtataaaacgggtcatacaggaaacgatgtcaggaaaattaaccgaaatcatgcccggcctgcatgtgccggtaacggcaccgctgtcctttcgccgtaaggcgcaatatcaggtgaaatgttatcggcggggccagcgtaattacgtccggctgaaggaaaaaggcaccgggtatctgaaaattaacgtggggctgttctggcggctgttaagccgtgatagcgggcaatcgtgggagctgatgcaccacgaacgctacaacaatgaaattcgtaaatcgtaaatgtgactgaagtcgtgtcattctgcgccttgtgcaacgccacagggtgcagccctgacgttattttcacagattaacaccggagagaagggatcatgataaacctgtcagcagacagcttaattgcccacaccatagccaaaatgaaaagccgtctggaacaacgcaccggcgatgacgtttcacagctgcgcagtggtctgctgtttatgggtaacattcaggatgcctatccccgtcgcctgttactggatgatcgcctgtcaccactggataaaacgggctggatgatgatccgtttgtatgcgcaacaaaataaaggggcggttttccccagctacgatgaattgcagctgctgctggcctcgccctataaaggcaaagcctcccgtgaaaccgtcagccgggtattgctgatgctgcgaataaccggctggctgagtttatgcaagcgtatccgagacgagcatgggcgggtgcggggcaatatctatgcgcaacacgatgaaccgctgacctgccgtgatgccgagattctcgatcctcactggctggatactgtggcagaagcctgtcgcagcaaaaaccgcactatcagccagacggcacgggaggtactgactgacattcaagaagatccactgatgcgtcatcgtcacagtcatatccgtttgctggaagcgcggctgaatgcggtgcagacgccacagcaaagggtcatgaggcaggcgcttcaacagggaaaacagcaaaccgaactcagggaaatgaaaccgggttcggaaaccgaatccggtcagttaaaagggcagaataagccgaattcggaaaccgaactcagccttaaatcaacggtttatcgtcaaaccactaaaccgaactgttatgtacgttctttcacacagagtgtgaataaaaaaacatacgtagatacaccgtccgctatttttctgccggaaaagttatgcaggcaactggagccggaagatggggggatgctgaacagccagttgcaggcactgcctgctgaacaggcgcagactgtgttgacttgtctggataaagcgttacaggcaggtaaaatcggtaatccggtcggctggctgctggcgatgatgaaacgggcacgggagggaaaactgtatgtgcaggccgaaccggctgtcacgacgacggcggctgcgaagaaacccgttgaattcacacgggaaacggcgcgttctgttccctcctcttcacaagcccatgtcagcagtgtagtgaaagacattcgtcagcggctggcgcaggcaaaatatcaccgtgatgacatggggtaaaaaccgggttgtgttgcccggaacagccatgattgaaaattatactggtgtgcccggggcacaggcgactaaaaattgtacttccttgtttgaggcaggcaagtctgaaaatctaccgtattgcctgagacagcagtggttgaaaatcatactggtgtgcccggggcacaggcgactaaaaattgtgctgccttgtttgaggcaggcaagtctgaaaatctaccgtattgcctgagacagcagtggttaaaaatcatactggtgtgcctggggcacagacggctaaaaattgtactttattagccgggtgacaaagacgataaaaataatcttttctacgatcccgaaaagggatcgttttttccttttttcataactgattatctattgagtcgcagacacctttcccctgatagtcccacagacataaaccgaccaaacaggagttgctctttatgtctgagcctgacgaaaaaaccgcaccgtcgcccccccgtcgtgccggtgcactgaaatccgcgttaaccattgaactgcacacccactatgcgatccgcctctgggaaggacgtaaaaaagaagatcttatcggtcgtcgtcaatacccggacattatcggcatgccgcaggtgattaaacgtgccggcaccatcagcgtggatgccgctgccgataacccgtatgccgacagctggctgcttaaactggaacaggcattggtgacggcgtcggccagtcttcagcagagtattgccaccttgcaggagatcctgaatgccctgccggcgcagattacgttatcctccgtctcctccgtcgaaccgctgaatatcggcgtctacagccattctccgctgggttaccgctgtgtctggctgctggtcggttatgaccagctggcgatgaaaacctttcaggcctttcattacggttttatttcccgctcagagcgggatacgttgctgcataacggcagccgggtgatccgccagatttatggtctggtgcgttcgtaccgtcccctgaaggtgacccgcgcggatattgaggaaaaaacgccggccggccttgaagccattaaatggctgggcgaaccggaccccgatattctgtcgggccggttgcgttctgatttttcaccccccctgcgcccagtggctcaggatgcggggaggggatgatatgccactttatttatgtgaaaagccctctcaggccagagatatcgcccgggtgctgggcgtgaagcagcgcggacagggctatctctttggcgacagtattacggtcacctgggctatcgggcatttgctggaaatggctgcacccgaatactatggcgaacaattcggcccgccgtggcgcatggaacccctgccggtactgcctgtgcagtggcaatggacagtgaagaaagagactgccgatcagtttgctgtgatcagacagttactgaaacaggccgatgaagtgattatcgccaccgatgccgaccgtgaaggggaggtgatcgcccgtgaactgctggaattctgccgtttcaccggtcccgtcaggcggctgtggctgtctgcactggatgaaaccagtatccggcaggcactcgccgcaatattaccgggggagaaaaccgagtcgctctggcaggccggactcggacgggcacgggctgactggctgatgggaataaacctgacccgcctgtataccctgaaagcgcaggcacagggatttggtgaggtgctgtccatcgggcgggtacagacgccgacactggcactggtcgtgaaccgcgacaacgatattgcccggtttgagccaaaaccctactggcaggtgattgccgcattgcaaaaagatgacattagctttcgggttaaatggctgcctgcgcccgacgattgcgatgaagaaaaacgctgcatccgggaggatatcgcgcagagtgtggttcagcgctgtcagcaggcacaagatgctgtggtgactgaactcacgcagaaacgggagaaaaccccgccgccgctctgttttgatttggggacgctccagcaggtggcttcccgtcaatggggaatgggggctggtcaggtgctgacgattgcccagtcgttgtatgaaacccataaagcgaccacctatccgcgcacggattgcggttatctgcctgtttcaatgcgggagggcattccggccgtgttcactgcgctgacccgtaccgatcctgcgatgaacgccattatcagccagctggatgccagcactctttcccgagtctggaatgacagccaaatcacggcgcaccatgccattatcccgacccgccacccctttgatatgacaaaactgaccgcggatgagttaaaggtttatcagttgatccgccactattatctggcgcagtttctgcccgtgcaggaaacagatgtgactgaggtgacattcactatcggcgggcagttctttcaggcgaaagggcggatcagtgtggtcaggggctggaaggcgctgtttgccgatgaaaaacaggcgcaggagcaggacgacaataccgctctgcctgcactgaaaaaagcggaaacctgcccggtactccgtgctgaaatacagccccggcaaacccggccgcctgcgccttttaccgaaggtacgctgattgccaccatgaaaaatgcggctgcgtttatcagtgatccacagcttaaaaaagtgctgcgggaaagtgccggactgggcacggaggccacacgggcaggtatcattgaagccctgtttaaacgccagttactggcgcgaaaaaagaaaaacctgcatgcaacgcagctggcgcaggagctgattgctgggctgccggacgtcctgacccatccgggcatgacggcactctgggaacagtcactggacgacattgcccagggccgggccacactggatggctttatgcagaaacaggcgcaatggctggcgcatttagtggaaaagggcaaaacacagccgatccgatttaccctgccgaaaaccccggcttgcccgcgctgtggcggcccgatgcaaaaacgggcgggaaaaacaaccccgttctggggctgcacttgctatccggcatgcaaagggatgctgaacgctaacgcggtgaccggttcgcgaaaaacccggcggggaaattcgccggactgaaaatgggattaaggattgaccgcacggactggtgctttaaaaatcatgctgttttagccgaaaactcccgtagcctgaaagggagcgcatgattgcggtacatctgcccacctttggaagcagatattgtcagtccagtggcagtgaaggtttttttattctttattagtaagtcaacaacgtatgcgtctgacgcccggcgggaaaaatcattcccgtcagggaacaggattttctccgtcacaccttattttttactccatggagaacatcgaatgtctgagaacaccgtatccttaaccaaaaacgactatttcaacctgaatattaagggactgggctatctgaataatatccgccatgtcagcaccgccagcgggacgttcctgagctgtgtgatcaatgcgctgaacgggccgggtgataacccggtctatgtgcgttttgatattaccgttgtcggcaaggaggcgaccagtctgatcggtcgttgccagaaatccgtagacgaggacaaaaaagtgttgttgggcttcacgttaagcaatccctcaaccgatatttttaccctgaaacgcggagatcatgctggtgaacagcgcgtcagcctgaaagcccgtctgatcaaggtcgactggattaaaatcggtcaggaaaaagtgtatcaggccgaacaatccgactcgatgccgcctcagaacggcatcacgcaaaaagaatatgcagagaactctttctgatattcctttgtgattcctctgacctgccctgagctttcagggcagtccctttattatcaaagacaacaggataccactatgaatgttgcaccgattggggttctggccctgcaatattgccataaacaattaccgttaatcgttttgcgccgccgtgcggggttttatatcggcacgatggatgaaggcattccctgctctcgtgagtcagtggagtattttgcccgacgtgaacaggcggagtttgccctgaaacaggggcaatggacacaacgtcacccccgataacaggagaaaacaagatgtcttcacgcggtgtgaacaaagtcattttactgggatatctggggcaggatccggagatccgctacctgccgacaggtggtacagtggcaacactttcactggctacgtcagaaaactggaaggataaacaaaccggcgaactgcgggaaaaaaccgaatggcaccgggtggtaatttttggcaagttagcagaaattgccgaggaatatttgcagaaaggggctcaggtttacattgaagggcaactgcaaacgcgtaaatggcaggataatcagggccaggatcgctattcaacggaagtggtagtgaatgtgaatggttcaatacagatgctggggagccgtaatgattcaaagagtatggcacctcaacaggcagggcataagccagcacaaaagcagccatcacctaaacctgcgaatcaggaaagaaaaaacacccgtgcgttacaaccgctagcgttaccggtaaaagaagacgctgattgggattcggagatcccgttctgagtggtgtttttatcattaacgcattgccctgtctcaacagggcttatttgtatatatgggtgtctgtaagtcaaccaattctgaattccatttatatatttaaattgttatcaatatctcaagtttatgtagccattcatcaaataatgggcacttttctctcatcttagggatgcctattttctcggcaatagcgattccagttgtggttttggcaaatactccattcgctgaccattttcccaatctctttgaaggcgctgtttgtgggctattgttaatagattccggttccctgcattcctgaagtacttgctccacttcttgttcatcaatatttaattcattggcaagtatctctttgtcactaaagagtaaagcttcaaattcatgcataacaatgtatgggataaaacgttcatcaactctctgtgctggcaggaattgacgaacttcattttgtgttgaaagatgcagatgctcggctatttgttttggttcccaatgtctatttaacgtctctaatccaggccattcattggtaccgtaataatcaataaatgttgtcacataggtcgttggacgttgtttaagatgcatctcaatgtctttcttgactcttgaaaaacgcacatctccacctttttgtccaggcttagacacctgagttgcagagatgaaaatcattttctcagccagataaggttgaagcattttttcaataaaaatttgttctgttttaccttcaactatagccatgacttcgatgtaattactcataagttggccctccggcgatgacgttcttagcccataattcacccagtgaatagttttcgagccattgagaaaaatcttcctcatttaaacgttcaaagcttgaagccccctttttacgatttacgatgacaatatctgcggcggagaattgatcgattaaaataggggattgagtggcgataataacttgggtacgctgagccgtttgttggattaactctgcaaggatcacaatagccgcagggtgcagacccagctcaggttcatcaataataatggtcgatggcggatttggttgtaataatgcggttgccagacaaataaagcgtattgaaccatctgatagatgataaggctgcatcggataatctgagcctttttgcgtccagctaatgttaacttcttcttttgaaccgctttggcgaggttccagaataaagttatcaaagaaaggggtgactaatctgattgcatttacaattgatttgtattcatttggagcatcatttttaagttttaataagaacgctccaatgttagacgcatctgtacgtaatgttttgttatcctggatgatttcatatttccgcattccggctgtagcgctggtatcatgaaaatgataaatctgccaggacgctatggcatcataaacgggttttgaatgccttgcatcaagggactttttctcgatttcagcaaccattctggatctgccatcatcactatcgcccaattcccaccatccgtcgccagcactctttatgtaatagcgagcttcgtcttcaatcgcacagctatctgctggcgtgggaactaatttaaagcgaaatcctctttccccgaagcgtgtatcaaactccattttttgcgtgactttattgccattaaaaagtaaatcacttgcaccaccactatcgcggacatagcgatttaatgtgccgtctattaatgcccgcagcattttaaaaaaggagatcaaattgcttttacctgcgccgttagcgccaacaattacgtttaagcttttaagttcaaattcattaagctcatggattgatttaaatcctttaatcgtgagcttgtctaaagacgtagtcatatcgcctcctttgaaatgctttacttcggtatcagacaaggggataactattgatgataaatcatgcattagagcagttatatttaatgttaacataacccgctgatggccggggcactattctctgaatcaagtgtttctttggttatgcttactgttagagataagcacttcaacttcagttttggtattgttgaatgaataaaacgatgtatcaaatatgcagggaagttgaattgacgaaggctaataacttaattttactgattaaacttactcgttcgattattgaattagataacgtaattcgttaaagtaaaaaagctatcggcaaaatccgatagtcaaggaatctcacccttgctaagagtaacccactggtaggaattttctgccagtgtgcctgctatcgcaccttctatggcggttcaggcaggggaggcttcggcctcgccggaaggttactcccggttgtgagatccctgtcttgaatcgccaccattcaataatcaaaagaaggggaagcaggtatgactatgactcacactcagaaagactggcacccagccgaaattatttgtgcattacgcaaacgtggtacaaccctcgccgccgtctcccgcgaagccggattaagctcttcaactctcgccaacaccctgtcccgcgcctggccaaaaggggaatggatcattgcgaattatcttgacgttcatccctctgaaatctggccgagccgttattttgaccaatatggtcagttgattgagcgtaccgtgcgcaaagcggtttcagcagaatcttcagagcaataagcgataacgtttttatttcctaaaaggcagtttcagttgttgattgaataaatcctgttatttcctgcacattggcgctttgattgccgggcaggaataacaggaatgagaataaccgtattaatgggcgtattggtcacaatcctgacgggttgtcatgccccgtcaaagcaactgccatctaaatgtactcccgaaaaagccatttcagcaacgcagctcacgcgcaatattcagcccgtctcacccgatatttatcaacaagcaccggaagttgtccgttacggtcgttatatactggtaagtaccgacccaacagcagcacagcgtgacccactttctcaattgattgaggtgcatattcctgcttctcagaatcccaccgtggccgatgccctgcgtgacgtattgcgtcagtcgggttatcggttatgtacgcctgaaaaaaccaatgacattttatatcgtcagccgctgctgtcggtacattatcagttagctcccatccggctgcgtaccgctttgcagcttatggctggcccggcctggcaactggaggtggatgaggtgcaacgtgaggtttgtcaccatttgcggccgggttatcagcttccacaaccccggcagggaaagcagccatgagattgcatcaaatcggtctggtaacgtggatagtactcagcagcccaacatgggcagccacaccgtcacccttaacgtcgcagcaggcacatacggtggaaagccaaaagcaaacattgagaatacaggccgggcaatggggattgaacgcggatgaatatcagcgttatcagcaattattgaatggtccaaggggtatccagtcgccggggcttgacccgttgacaaccctggggattgaagctgaaagtgatgtcgaacgtcgccgttatgctgaacagtgggtcaaagccgagtttgcccgtactgaaaaagaactgcgttttcagcgggaagtggatgccgcctggcaacgattatttccggatatgttgccggtcaatatggagaaatccggtgaggcaaaggagcgtttggcgttgtttgtcaaaatcaacgattgcccgccgtgtgatgcccgtttagcggaagttctggcgttaatgcaaccggttgacatttatctggtcgacagcaagggcaatgacgacacattacggcaatgggccaaaaaacaccgaatccctgttgagcgagtgcgcaaccggcaagtcaccctgaatcatgatgcagggtactggttcaggtttgggcagggtgttatgccggtcttattgcggcagggagagcagggatggcatatcacgtcatgataatgaaagggttgcgcgtattccccattatcgggatgctctggttcaatacctgccatgcggagctgaacgtcattgccgatttaggcggcaaagatgcctcgcctttttatgaaagcattaatgctgagcaacgcgatgaccctgtgtcatcggtgcagaattcctcacccgaaatggcaggtgaagcggcgatgttgcctgtcaaaacaccggaactgacgccgggaaaagtggcaagcagaccactgcaactgccgggaattggcgcactgtttctgattggggatgatcccggttcacgccagtggctcagtcagaatgcggccacattgacgaaactgcatgctgtgggtctggtggtcaatgtcagtgaaatggcgggattacaatcactcagggtatcagcgccggatttattgttatcgcctgcttccggcacagaactggctcaccgtttgccgttgcagcattatccggtgttgatcacggaaaccgcactttcccaacagttgtcaccatgagccgctgttatgtggtcgaagcgctgctgcgtcctgccgttgaactgaatactgctgtggtctcagtcgttgcggcttttgtctgtatccgggcaccctgggccatcgcactggcaccttcagtcagctatgtgatggccggtggttttactgtattagcgatgatacgcacatggcagggtattcaggtcatccgttatcgcagaaacctgcgtcgcctgccacgttaccagatgagcacaaagcaaattcctgtcagtcacaggcaattgtttctgggcaggggatttcgctggcaacagaagcatattcagcgtttgcaggatacgcgacgaccggaggtcgaacgatttgtgcaacctgcccggctctatcagcttgcccgcgcactggagcgtcgaactgaataccgttggccaaaattatcggcgttgttacgtcaggattcgccatttaatccggtacgtccgttgccaccagtgggtggcaatcttgctatccacggtattgggccacaggaagccgatgtttttatggatctgcgcgagcgggtcgggcatacgctggtgatggggactacccgtgtgggaaaaacccgtctggcagagttgctgattacacaggatatccggcgtggcgaggtaacgattgtctttgatcccaaaggcgatgctgacctgttaaaacgcatctgggcggaagcacatcgggtaggtcgcggcaatgaactctccctttttcatctgggctggccggagatatcagcccgttataatgccgtcgggcggtttggccgggtatccgaagtggcttcccgtctggccgggcagctcagtggtgaaggcaacagtgccgcattccgtgaatttgcctggcggtttgtcaatattgttgcccgtgctttggtggcactggggcatcggccggattaccagcttatcacccgctacgtcaataatatcagcgaactgtatcagcgttatgccaccagagtgatggaggagaggatgccggcattattgtcacagattaaccattacctcggcaccctgaaagaaaaggatgtgccgcgcaatatgcaggggcaacccgatgccctccggctctgggccatggaaatgacgctgagttctgacacaggaaaacaactctatgacccgattttggacggattacgttcggccgtgcgttatgaccgcacttattttgataaaattgtggcgtctctgctgccgctgctggaaaaactgaccacaggcaaaattgccgaactgttatcgccggattacctcaatatgacggatatgcggcccatctttgactgggagcaggtgatccgcaaaaacggcattgtttatatcgggctggatgcactgtctgacagcgatgtggcttcggcggtaggtaacagcatgtttgcggatttggtcagtgtcgcggggcagatttacaaatatggtatgaacgccggattaccggtacgtcatgatggcaaactggcgatcaacctgcattgcgatgaattcaatgaactgatgggcgatgaatttattccgctgattaataaaggtggcggcgcgggcatgcaggtgacggcatatacccagacctcctccgatatcgaggcccgtatcggcagcccggccaaaacggcgcaggtgataggtaacttcaacactttgattatgttgcgtgtgcgggataaccggacggcggagttgctcaccagtcagttacctgaagtggaaatctacagcaagaccctggtatccgggcattcggatattgccgatgttgaacagggacaggatttcacctcttccacacaggacagggtaggcaccgtcaaaacgccgcttgtcactcccgctgaaatgattaacctgccgaaagggcaggcgttcgcgttactggagggtggacagctgtggaaaatccgcatgcctttgcccacaggcaatgaggatgatgccctgatgccagccaatttgcagaaaattgccgaacagatgcgcaggtactaccgcaccagtgaatcctggtgggaagagaaggggtagtttccgatatggcacagtcagaaaatcagtcccgcccatcttcccaaccgccccgcaagcatggtttgttgtatcgtgtgttatgggaatggccgtggcaactcattgggtttatggcgatgtcttggctattcagcctgttactggaatatcttggtatggcttttttctggccggaagagggtgccactcacagtcagaatatgatgaaggcagagcttaactatctctcctcggaatttacccgaagcctgttgctgtcagaaccctcacaaaccgtttcggcatggctggcgcaagcctatcaatgggtgtttgtggacagtggttttatgggctgggttcagggacagtcgcaataccagttcaatagccgcaatgattttatgcgtgaattcaattccgtattacagggtgtatcgagctatttgcaagaatattggctggccacggtgtttatcacgatggtgacgttgacccggatagccattctgctgttatccgtccctttgtttgtgatggtgatttttgtggcactggttgacgggctgggacgtcgggatttacggcgttatggtgcagggtatgaatccagttttgtttaccatcatgcaaaacgggggataaaaccggcctgcactgttccctgtgtactgtatttatcgtggccggatgtggtgtatcccacggtgatattgttgcctgcggcgatagtgctgggcatggcgattgtgataacaacatccatgtttaagaaatatttgtaagatgtgcgctggatgctggagtgcaaaacattttttgttttgcactccagcgtcagcagacaagccgccccgcggcgcgtcagtctttcaggctaatgctggtattttgacggtgcattcaccacctgcgtcatccattcaaaccagtcacacgctttacagatacggttatcctgcttcgggtcaaaatggtagtgatgatgcgaaatatcttcacaatacccgacaaacggctgatcgatacggtgtaactgaatccttgcggcctgctccttagatgctggaaaaaacgcgccgccaatttcggtaaacagttcggtatcatccagcggcgcatcacagtgttcgcagtggtttatccagtgctgccgttgcagcggctggctgacgactttgcgaaggcggtggtgaaagccaggcagcacgttacgcatgagggtaggaagatcggcgagataaaacaagaacgccgatctgtcctgctcggtatagtcaatttctgtgttgggttcatcgtcgctgtccgcttccagcagcttatgtccggcaggcagcatacaggccgtgacggtggtgttttcctgacagtgcgggcaggctgtctgagtctgggcgagataccagtattctgcatggacattgtagaacggcagccagttgataaacggcgtcgggtcaatgctgttgtcgatataccagatttgttcgacggcatcccagtgcgcacccagcttccgtgcctgctcgtattcctcatcagggacgcttaaatcaatccgcagcatgtctgttccttcatggttaaatcgttaattaaataaattagccggactatttagctaattttcatcaaagcataaagagtttattgctgatttgccgtaaaaaacctcgcatcctcgatggcctgaaatccatcacgaggtgaatgtttatgcgcagttgcttttccctgtcccattctgcctgcctgctgagtctgatcttggtgtgtgtaccgcttgcgcaggcggccgagaaagacgaactggcgagtgccaaaaaactgattgagcaggtacaaatggcactggaacgtgccaatattgccgaaaagcccgctgacaccgaaaaacagccccgctatcactttgattacacccgaatcaaaaccgatctcaataccatcaaaaccggtattgatcactacctgatgccctcccgcgatcagccggatgagccagccccgttatccggtcagtatcgtcaggaacgtcggcaatgacccccacccagcgcaatgcctttgaggtagcctcggggcattttgatatcacttttttgtatctggtctgcgtcggatttttcctggccaccctgtttctttgggcagcctgggccgcggtcgatgtctggaacggctgggcgaatgaaaaagtacgtaaccagaccatcagccagtttgctatgcgaaccgccatcttactggtggttgcggtctggatgtttgccagctgatgcaacgaacataatgaacaaggaatggattgaacatgaagtcaatttttactgtctgtcgtcgtatcagcacgaacctgataaccagaataagcacctttcttttgctgttcggtttttcctgtgaatccgcctgggccgatttgccggctatcgaaccgccaaaaagtggcggtggaggcggattactgggacaggtgaaaggctatgcgcaggacggcattgtgattggcgggctgatcctttcggcagtcgcgttctttaaggtcgcctcggcggcggttgaaaccttttcggaagtgcgggacggcaaagccacctggacacagtttggctccattattgtggtcggcgtggtgctgttggttgcggtgatttggctgctggcgaaatcggccggcattattttttaaggtgtcgctgatgcagacgatccctttcttacctgatcgcttaaatgccgaaccggtcgtatttcgcggattcaccacgccggaaatggggctggccgctttgctggggctggcattcgggctgatggcgagccttccttttatcccgttagccggttgggtcatgataccgacgggtatgctgttcatgcccttgttattgattagttttagcggtcgctggctcgttcagcttaagcgcggtaagccggaaaattatctctggctgaagctggaagagaaaaaacgccgaatgggcatcggtgatccggcattgattattacggctcagggctggtcgttgcgccgcagcaggagcctgcgatgagtcggtttcgtcatgcgctgaaaaaccgtgaccagcatatcctgaccctgcggcttgcctgcggggtgctggtattggtcttgctgatcacgctcacgggctggatgatgtcaccgcgcaatctcactatccataatccgccggacttacgcagcggcagtacccgcccgtggtgggaagtgcctgcgccgagtgtctacagttttgccttttatcttttccagcaactgaacgcctggccgaaaaatggggcacaggactacccggctaaaattgcggccttgtcgtcttatctgacccccgcctgtcaggattttttgcaggcggatgccaaaacccgggccgacagtggtgagctgcttgatcgggtgcgggtggtgtatgagatccccggccggggctacgggacgaaaagtgtgacggtgcgtaaccgggataactgggtggtgcggctggatttggtggctgatgaatattatcacgccgaacctgtcaaacgggcgctggtgcgctatcccctgaaagtggtgcgctgggagggcgatgcggagcgtaatcctttcgggctggcactggattgttacgacgggatgccgcagcgtctggaagccatgccgcaacctgtggaagagaaaaagggcgtgttccaatgaaaagatatcaatcttgctcttctgcctgtttttggctggggttggtcagccttttgttgttcagcctcggggcaaaggccgatgaactggtgaaatgggaacgcattccgttatccattgccctcaaagtaggacaggagcggattattttcgtagatagaaatgtccgtgttggtttgtctccgtcactcagcgataaactgcgggtgcagagcgcaggcggggcggtttacctgaaagccagccaatcttttccgtctacccgtctgcaattgcaggacagtgaaaacggcgaaattatcttactggatatcaccgccaccaaaatggggtcaacggaacccgtccgcattctttatccggatgaaaaaaattctgctccaaaagaggggtcaccgcatcagagaaaatcagcactttcggctcccgcgcctgtgatattaacccgctatgccgctcagcagctttatgccccgctgcgtaccgtcgagccggttacggggatccacccggtcaatctgcatttacccggatccatcacgacactctacccttcagaaccgattgcggtttccccgctggtcggctggggtgtgcaaaattacacagtggtagccctgaaactgcgtaatacggctaaacgcaacatcacgctcgacccacgggctttgcaggggcagtttgtggcagcgacgtttcagcatcgctggctgggcgaagcagggacaccggaagataccacagtgctgtatcttgtgacccgaggacagccggataatgcctttatccctgagccggtaacggtgaaaccgggaggccgtcatgcaggttaaatccaacagtctggtgaaaatcctggtgccgatggtgctgatggtcggcgggtttatcggcatcaaaagttgcagctcaacagacagtaccgcacccaacacaccccagaataatgttctgtccacgttgtcaccggaggagttacaggcgctgggtgtcggcggtgatacgccggaagataccttgcgtacgctggtgggaacactcaataaagtgcggtcagagcagcaacgcttaggtcagcagaatgccgatatcctgaaagaaaatgaccagttaaaaaatcagcgtcaggatgtcgccggtcagatagacgcggcggtggcagctatccggcaggacgatgaacagcgccgacgtgaattacaggatgaacagcagggattgctggcacagattgatttactgacagaacggctgaattcaacgcctttgtctgcgccggacagtccgataccacttgggtcgggaagtattccgtattctgccaattcaggcacagggcagaatgaacttatctggataacacccgccgatgaaaagcccgcagacatacaaacccccggcagtggaaaagccacggcgcagttcccggcctcttttttaagtgaacaacctgctaccgggcaaaataaaccccaaagcccatcgcttcaaaacccatcaaaggaagaaagtgaacagccaatctataccctgcctgaaaatgccacgttagtcggtagtcaggccatgaccgcattattaggccgtgtccctgtaaatgggacagtgaccgacccttatcctttcaaaattcttatcggtaaagacaacctgacggccaacggcattgaactgccggaggtggaaggggcggtggtgtccggctcggccagtggtgactggacactctcctgcgtgcgtggtcaggttaattccatcacggttgtctttcaggacggcacggtgcgtaccttgccgggggcagggcaaaacacccacggcagtgcgaacggcatcggctggctgtccgatgaaaacggcattccctgtatcagcggtgaacgcaaatccaacgccgccacttatctgccgacattgtttgcgctctcggccatgaattcggccggcgatgccctgagtgaaagtcagcgtaccgcccaggccaacggcacaggcggtatcacgaccgcgttaacgggcaatgccggacaggccgcattaggcaaagcgatgtcaggtggcatgaatgacatgagtgaatggctcaaacagcgctacagccagacgtttgatgcggtttacgtcccgcccggtgcccgtgttgtggtgcatatcacacaacgcctggcgattgattatgaaacgaaaggacgtaaggtgcgctacggcgtgagtgagccagcccaacgtgataatcaggaagcattagattaatggaaaagaccccttctcagtggatattcagtgcgggttccccgtattgcctgcaagtgtcggtgatgtcactgactgaacccgcacgggtgcagctttactggcgtgcggtgcgcaaaaaagagtgtcggttgtatctcttaaccgacagagaatgtcagccgttgagtgacggtgattttactgtcttccgcctgaccgaaacccagaggcaggcagtggttgacggtaaagtcagcatggcgcctgaacagtgggtacctttgccttttaccttatcagagctggcggtacacccggaatttgccacgtttaccgtccttggcaccccggaggctgccgtatgcggaaaataaaatattattggctattggggttggcagggctattagtcggatgtaccacttcgaaagacgccttactccctgccggaaagcagacagtactggcaatgtggcaggggaataaggcaggtcatgccaccgaatcggcaagggaaacactgcgccgttctttaactgtatctgaacggctcagggcactggaagaaccttatcattacagccgttcggcagcgcaggaaatcagccagcaatttccccgcttacccaatcccgatatggtgatgtatgtttttccgcatctggtcgctggcaatacgccgataccgggttacagtacagtattcccgttttatcagcaggtacagtatgccctgccgggtgaacgcatggaggcactgtaatgaacatccccaaggcactgaaccgtcccggtaaattgcgtgaggtggatgaagccgcgatttaccaggcgaacccttccatcatcgattacctgccctgggtggaatatctggaagacgggcaatgtttattgttggatgacgggatttccgtcggcgcggtctatcagattgaatccattgctaccgaaggccgtcccgctgagcggttgactgaaatccgggatcaactggaagatgcgatccaggacagtctggaagaagatgatatttcgccgtgggtggtgcagtttttttgtcaggatgaagatgatcctgctgactatctcaacaccttgcggggctatgtgaaaccctgggcacagggaacactgtttactgacgcctttctggcggaatctgagcatcacctgaacagcattgcccggcctgacgggatatttcaggacagcttaatcaccgggcaaccgtggcggggccagcagcgccagacccgcatggtggtttaccggtggctgcctgacgggcgcagatcccctgtcaaccatctgaccttatcggcggtggctgcgctcaatcaggtctgcgagcggctggtttcatcactggcttctgtcggtgtgattgcccgccgacaacatggcgggcagatccaccgttggttgctgcgtcattttaatccggcgccggattgggggatggcaaaagccgatttttaccgtaccgtcagttatgaagcccctacacaatcggatctccccgtcagtaatgactttgccgaaagcctgtggttcaccccgccggtgtctgatcccgacgcgggcgtctggtggtttgacgggttgccgcataaagcggtgctggttgagcgtctgcgccgtccgccggaaccgggaacactgacaggcgaagtgaaacggggcgacaatatcaatgccctggtggacatgatgccggcagggacggtggtttcgctgaccattgtggcgcaggcacaggacagactggaagaggactttacccggctgtcgaaaaatgcggtgggagaaaatactgaatcgctgcgcgtccggcaggatgtgcaggaagtgaaggaacttctggggcggcggcataaattgtaccgcagtgcgctggcctttctggtgaggggcaaggatctggatgatataaaccaccgggtgcatcaattatcctccaccctgctgacagcaggattacagcccgtccggccggaattcagtgtgtcaccgctgaatgcctacttacgggcactgccgatgtgctttaacccgcagaaagacaaaaaacactggtacagccgcctgacctgggtacagcatctggccgggttattgccggtgacaggccgttcgaccggcaccgggcatccggggttcagtttctttaaccggggcggggcaccgctgacctttgatccgatgaacaaacaggatcgcacccagaatgcccatttactgctgtttggtccgaccggcgcggggaaatccgccacactgtgcgcctcgttgatccaattaatggcagtacaccggccgcgtctgtttattgtggaggcgggaaacagttttggcttgctggccgattactatgaaagtctggggctgacggtcaataaaatcggtatcagaccgggttgtggcgtcagtctggcactgtttgccgatgcccatcaactgctgcaactcagtcctgagcaattgcgcattaacgaagctgatattcctgataccgatgaacaacaggaagaggaagctgatgaacagcgcgatattctgggcgaaatggaaattgccgcccgactgatgatcaccggcggtgagaaaagagaggaaaagcgtctgacccgctctgatcggggtttaattcgtgaggccattatgcaggcggcacagaccagctttgacgagtcccgccagatggtggcgtcagacttacaaaatgcgctttatgccatcgcccgtaatcaccagcaggatgagcacggtcagcctttaattactgcacaccggcgggcacgggcggatgaaatggccagcgccatgtcgatgtttacacaggggtttgagggagaattatttaaccgtcccggtacgccgtggccggaagtggatgtcaccctgattgatttggggacactggcgcgggagaattactcggcgcagatggcactggcgatggtctcgctgattaacaaagtcaataacctggctgaacgggatcaatatcaggatcgcgaactgcaactggtgattgatgaagggcatatcaccaccaccaatccactgttatcaccctatatgactaaagtggtcaaaatgtggcgtaaactcggcgcctggctgtggctcgccacacaaaacttagcggactatcctgacaccgccgaaaagatgctgaatatggccgaatggtggctgtgtctgaccatgccacccgatgaggtggagcaaatcgcccgttttaagaagctgactgaagagcagaaagcggtgctgctctctgccagtaaattaccccgttgttataccgaaggcgtggtgctggcaaagaaaatcgaagccttattccgggttgtacccccgagcctgtatctggcgctgggcatgacagaaaaagaagaaaaagccgaacggcgggcattgatgcgggaacatcagtgcagtgaactggaagctgcggtatgggtggtcagaaaaatggatgttgcgcggggattgaaggttaattctgtagaacactgaacattacatttagctcattgagtaataatgccaatggtggcaggttgatgcgctatcccagcacgatggccgggatagcgttcaggttagtcttcgtatttgaagtcgacattgagcttcattttttccacatccacggtcactatacagcctgaccaatgcggcggttgcttcaaatggatgttttctacaaaaaattgcctgagtgaaactaacaattctctaattctttcatttgttaacccatcgttctcttgaggggaaaaccaattcatctcatcagctgagttaatataatcatatttaaactgacagcaatctccctcaggagataattctgtatccattatgattttttttgcataatcaggcgctgaattgtatagtaactgacctatttcagcatatattttatcgtctaaactcatcatttaccttttgctgtctgtatttaaggaataactttatgcgatggatggaagtgttttcagatcaatcttcgtatttgaattctatattaattttcatcttcttaagatcaacagtgaccaaacagccagaccatgagggatgatcattagtcaggttattttctacgtagtatttacgcagcattgctaaattttctataagctctctatctgtttttggtgatggggggaaataccactttttacacccactttcatcaatatagtcatatagaaacttcacatgatcatttccgggagataactctgcatccagtaaaatcgtctgtgcatcatcaggagccgcttcatataatatacgaccaatttctgaataaagttcatcatcatttatcattattgacttcctgatacatttctaaactattcattaattatctccttgtttataattatgtaatttttacaatgagaaaaagaattaaacgcagtagctgagctgttttttcggcatgttacctttttcatcatcaatgaaaagggtaacagtcagtgttgcaaaaattccaattctctctgtccaataacgcgaattttctgattatcggcctgttgagtctattgcttagttttcaggggcaggccacgtcagaacagaaaaacgaaggtaatctttctgcccacaaactggctgacatcgcctcacaattagggcagcaacttcaccaatcgcaatcccccaccgacgccgcacaatcaatcgctgctcagcagctgtcgtcggcagtcactgccacattaaccccgtggctcaaccaattaggcaatgcccggatatcactcccttttgatcacgctttttcgttaaaagaagccgtgctggattggatgctgccgtggtataccaccccgggctataccgcattcagccagtggggagttaaagccgggcacggtcagacgaccacccatcttggtatgggataccgctatctgactgataactggctctggggggctaatgcgttctgggatgctgagtggccagctcaacatcatcgctacagtatcggggcagaagcgtggcgcgataacttcaaactctctgccaacctttaccggcgcttatccggctggaaaacgtcccgaaaagtcaccgattatgatgcgcgtcccgctaatggctgggatatccgggtagaaggcgggttacccgtgttgccgcactggggcgggcaggtggtgtttgaacaatactacgggcagcaagtggatttattcggtgacagcagacgtcagtacaacccctacagcctgacggccgggctgacatacacgccggtgccgttagttacattgggcgcggattttcggcacgggaagcaggatcaccgggataaccgttttacgctggcacttaattaccagctgggcgtccccctggcacaacagcttgatcccaacgcagtcgcgccgttacgcagcctgacattcagacggacagattttgtcaaccgggagcataatatggtgctggactaccgcaagcagacgctgataacattggactttcccgttcagcttaaaggcgatgcaggcaaaatcatcacctttacgccacgaattacctccaaatatccccttgcgcgtttagaactccgggctgatgaattacagcaagcgggcggtaaaattattcaccagacgcctgacaaagttaggctgcttttgccaaaagcagccgataaaataatccggctttccggtattgccattgacaggcacggcaatcgttcccggccatcggaaaccaccctttttatccagccgacggaaacccatgtgcaggttaccgcaaaccggacgcaggcaagggcggacggtcaggacagtgtgatgtataccgtgatggtgaaagatcgtgacggtgaacctgttcccgatcaaacggtgagctggtcaagtgacaaaggcaaactttcacaaaccacacagaaaaccgatgcacagggactggcggcggtgttgttgagcagccattatgatggggagcatagcgtacaggtctcggtcggtgataatgtcaccgtggccctgccggtgcacttcagcgcggtattgaaacttgttatcaccgcagacaaaacacaggtcagagccaatggtcaggatgcagtgacgtttaccgtcaccgtaaagggtgctgctggcgttcccgttcctcaacagtccgttaagtggcaaaccagccggggcaagttcctgaccttgtcgtcaacaaccaataatcacgggcaggccaccgccgcattagtcagtttaccctctggtatcgcagaggtgtcggtgactatcggtgaagaaacgcttatggcatcaccggttgaatttttacctgcactgacccacacgttgacctgtgacaaaagtacggccattgctgatggacaggacagtgtgctttgcacggttgacgtgcgtgatgcggctgaccagccgatggtggggagggaaatcgtgtggtcaacagatcatggccagattggcgatgaacaggttatcaccgacagcaggggaaaagcccgggcacgggttatcagccggaaagccggtgtcgcccgtgtccgcgctgacatatcaggtaccatcatcacggcggacggggtcacgtttaaacgtcagttgcaatccgttatcatcgcggataaaacccacgccaacggaaacgggcaggaagctatcgtgctgaccgcgattgttgaagatgcgctggggttaccggttgaaaaccaggctgtcatctggcacaccgacagcggtgtcctgtcatcagcagagacccgaaccgactcgcaaggggtgacacaaattcaactgaccagcactgttgccggtgaacatcgggtatggattcaggttgatgataagacggtgactgccccgacgctctggtttgatgatgtgctgacatcaaccctgcatgcagataaaacccgcatgattgccaatggtcaggatagcgtcatattgaccgtgacggtgaaaaacctgaccggacaacccgccgtcggtatccctgtctggtggcgctcggacaacggtcactttacagacgctcagattgaaaccgatgaaaacggtgaagcccgtgcgacactgagcagccagaaggcaggcacagcttcagtaacaaccattattgatgaccaggaagttatctcgccaacggtggaatttatcccgccattacgtattgccgataccgttgccgttgacagtcagggcggtaatgccaaccagaaatcctttggcacccgggggccttcagttttctggcgtggcgcgaaattccgcatcatcatcgccgataatacaggccgggtgaactggcagagtgattctccggcggtcacagtatccggtgatacggtggtcgtacagcaacgtcctgatggtgtgagactgacaggtaccgatgaagcagggcagcaggtggtactaaccttaacaagcgatacctggttcgagcgttcaggcataacgaaagatttttattttagtgcaacgcaaatttgccaatcactcggcagccagattgcgcccaaatatgcacttgaacggctttatgaagaatggggaaatttttatcactatgaaggctgggtgagggaattttatgtggtttccacggattatctttctgccagttccggttcaatgaatgcgcagacaaaatgggcattctgggcagaatcggatagctggatgcgtaatgcctggcatcggctggcgtttgcgtgtggtgggtagcatttatctattatagatgaggcaggtggctgtattaagcagccacatatcgacaataccttcataatcatcgggagttactatactgaataaaccattctgatagttgttctaaccttcaaattttcaataattaagtaaattatcaggtagcctacctctcggtcatgtattaaatagttagttgttatgataatcttccggtatttcgtggtggaacatggctaaagtagatgttgattgtcgttattgtcacaaatcagaagatgtcaaaggacatggaaaaggtcatagaggttatccccgctaccgctgctatgcctgcagtaaagtctttcagttggcatactcctatcaagcctgcaaaccgggagtcaaagagcagattattgatatggcgatgaataacagcggcatccgtgacacggcccgcgtattgaaggtggcaatagctactgtgatgaaaacgcttaaaaactcaacccccggaacgtgacgacgcttcctcttgacggggataacatacatcttatctgtgaagtggatgagcagtggtcgtttgtgggcagtaagaaaaatcagcgcgggctctggtatgcctgggagccgcgtatgaaacggatagtggcacatacttttggtgatcgcagcagaaaaacattggaaaaactgctggcactcttgtcaccctttaatatccggttttactgtacggatgattatgccgtttatgattgccttcctgaagaagtccatcttactggaaagatatttacccaacgtatagagagaaccaaccttacccatcgtacccgaataaaaaggctgaatagaaaaacaatcggttattccaaatctgaagaaatgcacgataaagtgataggcactttcattgaacgtgaaaactatatttagcgagccttctaactatttaatacacgacctacctctccatttttctattgttacaaagggtactgttatatgctgagtagcctctccaaattcttcaataaagtaaccgaaattatcatcacgcattatttttccccttactccgacataattctaacataagaaaataagtggctttttatacagccaccttagtcaatagataaatatcagcgaaatagaaaatcaaatttcaaatatatcaggatcatcgaattggcgaagaatatcgaggtggatgtgcatatctaatttcctgacattttcaagtttgatttcgccgcctaaaacaatggcgggttcaaaaccaaatatttcgtgctctcctaataggccgtatttttctacggatttggaaaaaatacctgtttttgcgctgccttttaaatcaatatcgtcgattgatttcacagcaaaaaaagaagatatatcgtgatctaattctttcttttcttttttataagctctttggggagaataaaaaaaggtattaaaaacacaatcaagtgttaaattaattccggtttgttcgccgcagaggtaaagtttaccaaaaccacttctggcgatgacgtggtaagagtccattgattcgaaaggggtatcttctaaccacatatcaacaatatcttcataatcgtcaggattgacaatactaaacataccatcttgataactattccatccttcatgtttccagtaatacaataattgtcccggaagttttcccacccatttatctatagattcagatggtacaggcctatgttgggttgcttctcccaaatcgtcaatgaagcattcaaaaaattcatctcgcattattttttccccttaccccgacataactctaattgaacgttcattttagcgtcacctaacccgctgtcaattgcctctttagcagcattatctaatgattttattcgttttcctctccagctacctcctatggcactgttaattccagtatcacccatcttcttaggtgcatattgaccataaccacctgcaaccatgtctggttcgtgcagtgcagccaatccatcgaatatctcgtctgctttgttttgtgatattattttagcttcttttactgaggttcctttttttatctggctgttaaatatatttatttttatttcacctttcgcactgtctctaaagtcttcctgtgctttccctgccaagctattccgcttattcttcttataagcatcccgtgcaattttaaactcttcaggcgacatattattaatggcatcctgctgtctgcgcagttgtgcagaatattctttcaggaatgcctgacgttctttctctgtttttaatcgcttatagcgtttgctgttataaggattaaaacacggaactttagttagtttagcccccttaactttcccgccttttttttctggctcgttaggcttgcctgcgctctccttcggtttttcaaccttattcactgtttttttctttccctctttggcggtcactttttcaattgctttacctatattcttaacgcccccgactatgcctttaacgacacctttaaccgctcctttcgggttcagatcagccagtaccgcaccgagttcctgctccggattgtctaatgtcaccctgagttcatcaagattaccggtggctgctcttcctctggcctcttcagcggcttccgataacacctttgcctgctctttattgccaaaaatatcatgccaccttgccgcgtcttccatggcacgtgccgcctccagttgggcagccggatacgcaagttccgcgatatcaaccccaaaattccaggtatcttttgccgcgcctttacccatttcagcagcgcttttccctgcctcaacaaccacgtttttcgcgctgtcatacgcctgactggcgaaatttttttcgttctgtgggccgggcttgagtatcggacttgcttcaccgggcgctttcgtgacctgaggcggttgcccgacaatttcacctatcgtgttgccttcccccgtcggggcatcattgcgcgccttttgttccagcaagggtttatcactcaccgtgggcggtgtttttttggttttttttgccataaccgtctccttatgcgccgttcatccagaatttgtcaccgtgccgaagcagaagtttattgcctgcccggacactttttgagtgctctttaggatggcacttgcctcccacggtgccgcttttgatgccattggcgacgccgggctggtcgcccagtgtctgcggcacaaaactttgtgcgaaaaccaccatgggtttgccgtttgcccgcacggatttgaccgacacagagctttccgccagtttggccaccaccggatagggaatgggcggcgttgatgcacctatcggcgttttgcacacatccggcacaatgctgacgaccatccattgcgttgctgttcgggcgaaatagttatcagccatagtgcaactccttgccatcgcctaaatcgaccctgaccaggggagcatccggattcatctcaaaccgggcttccatcaaccggatggactcgtccatttcagcgtggtaacgataggtcatggaaagtgtgagcgcttcgctgtcgataattaaggtatccggatacatcaggtcaggtaacatttcgccactcagcattctcagcaggataaaagggcggtgtcccggcagctgcacccgcagtatgccctcacgggttaaatggaacaggctgatacggatattgttatccgggtggtcaatttgctggtcttccggcgcgttattccagtagctaaaatcaaaatcgtcagggagataagggtggcgctctttcagccaggtctcatcgtaggtacccgcttttgtgcggcggggcagccagggacggccaatcataccgaaacctgcaggccggtagccgggttcggtgatggcggtcggcggctctgagcatggggcgaagtactccccgatgacaggggcatcagggtgttcaatacgcggcgcgggatagcgggaaagggctttcgctttggcataccacggcgcgacaaatcccctgccaattgggttgtattcgaaagtggcatgggcgatgggaggggagtctttttccggatgctgtcccagttgctcagcggacagcctgaattcatcaaccacggcagcggccgccacatcgtcttcatagaccctgcattgccccccaaaggcgtactggtagtctatcggtaattccgtgaatttttgcggcggtgtcagctgccattcgtcctcagacgtgcgttgaaactcacgttctccccacaccagtaaggttttatcgataagcggctgccagtccgctgtcgtgacgagtaaccggacgggcactctttcagccggaatgccgcccggtgcataggccaccccgttgacaatcacatcacatttcggctttaacggcgctaagtcactttcctgtcggacggaggactggttgagttcaccactgaattcatcctgtaatgccagctcaccaaacggctcggttaatacggcctgataatatggcccgtcgccgacaggccggaactgatagacgattttcatcgcgacaacatgatattcttcgtcttcggtatcgagcatcttgtagtgcataaccgaaaacggagtcagatttttaaattccacctcaaagctccttagttcaggtcaatgtcctgtgcgctgatttgaatggcatcactggcctggaacaggaagttattcccctggatggtgacattacccagtttatccatgcgcaggacactactgccgcagcgcagttcaatcaccgtgcctgcggtaatggataaggattcaccgacgtcaagtgtatccgtcaggccaatggtctcttcccggtgttcatggacatcaatggtctggtttttctcgacggtctcagaatggtttgccagcacatgggtatcacggtcattgagtactttggtgttcatgtccttctgggcatggataaacacctcttcactgcctttcgcatcctcaaagcgcagttcgttaaaacctttgcctttatgggttttggtcttaaaggtggtgcgggttttctgggccggcaaatccaatggaggacggttcaagccgttgtagacacacccggtgacaatcgggcggtcaatatcgccgttgaggtaagagacgatgacttcctgcccgatgcgggggatcgccataaagccaaagccgttgccgttccagccctgtgccacccgtacccagcaggaagcgccatcatccgccttgtcataacggttccagtggaaatgcactttgatggcaccgtctttattgacgaagatttcttccccttcagggccgacaaccgtggcggtttcatcgccatcggccagtggcttgtaatggaacggcggacgccagtcggcaaggccgtcaataaagctgaactggttggtcagtgtggtgccgtcaccactgttatcgcccatggcctgtgggcagcggccgtgatggctgataccgacaatctgccagcgggcattgagcggggcgtgcggatgactttttatttcgaagattttgcccggcatcagtttgatgcagttactgctgccactgccggtttttttctggttatccagtgcttcatgacggtatttgagaaacggtttggcggcggcatctttctgaaaacgcccgtagctttcaaacacggtatacggggtttgggtaccaaaatcgcggaaaccttcgctgctggtcatatgggaaaggtgataacgcggattgtcgtaattaaaatctttgtggagactgcgctgcggactcatcccgacccccagtcgtacctgataaatcgtatctatcccatgggcggtttccggttgcgggctgtacgtcagtggcaggccggcggtcatcccgagatggctgtcactgaaaaacagcgtttcatcctcaaaccagaaactgatcccctcttctgcggctaatcggctgaaaaacccataatcggattcgcgtttctgggtcacgtattcccggtcctgatgggggtcatagagcttcgaatccgcccgcactttgtgctttttcagcagaccattcaggatagcgggcacattttgctgatggaatatccggctttcctgattgagcgtcaggcgccagagtgccgggcgaacggtcagggtataaagggttttattgccgtcggtaccggcccagtcagcgtgagagatgataccggtgattttacgctgcacctgtacgccgtgaaagatttgcaactccgcttcctgcatcagtaaagcggtcaaatccacctcgtctaacggcttgaacggattcaggctatgggttttgaccagtgtcaggttcaggataaacagctcggataacccctcctgcagggaaaactcccccacgctgaacgtatccccggggagccccgcgacctgaaaagtaaaccgcaatccacttttggcggcgggcagcctgtcaatgatattcttcatcatgttttgcttgactccttgttgtgatggtttgatggcttacatatctctgcgcgtaccatagacttccttaaatgtccacaagacgccgcgagtgtctggggtatacacatccagcctgacgaaggtggactggctgataaaacatgccatggcttcattgattaaccggcagaagcggtacatttctcccgaattgtggtaacagtcaggattgagcgtgagtcctacccagtgcccgcggacaggacgtccccgcttcatacgatcggtaaggtgttcttccacccgggcaatgccgtcgatatgccggcggatatggcggctcagcgggcgattgagttcggggtaagggtcaaacaggcggagaaactgtttcaggctgtcggtggcaaataacaacaccggcgggctggagaggcaggaaagcaacggccagccggaattgtcctgcaacagagatgggtaatcggcggagacggggagaatattgtgtacattgagatgggccggggaaccttcctgcgtgagggtaatttcaccgggttttaaggtgatggcctgcgtgtgatagcccagaatatcacccacgacggacagggcaggcaggtgttgagccagtttgccggtcaggtcaaaaaaatgcagctggtgcgtgagcctgcccagtaaatcacgctcgttctggagcaaataataaagcgtctccggctccccgtcttccgccagactgggcgatgacggggtaaactggtcgatgggcagataacggtagggcgaaccccgttgctgtgtttcatcaggttgctgaaccacctgaatatcgcgcagccggaacaactgcacggactcgccaagaagcaagggataacgatgattgccttcattcagcgggaggggaaggctggtcagggtttccagatgaatggccggaacacagtgcagtataaaagcatcgtcgacattatccagcggcaactcaccttcaaaacgaaaaaccagctcaaagctgccgtcggcatttaacggaatttcgcggcaactgtcactgatatccaccgtcataaagttatacaggtggggcagtgcataatattccagcagtaattgcaggccggcataagtgcgatttcccatcggcaggaggagagcatcgaacaggttatgccagccataagggaaactattcagtttgcgttgttctccctgcgttctgaggtgcatatcacagatatgctgatccagccacaaagttaattgtgctgcccgttcattgtccgtaccgaggaaaaaagacagtgatccgctttgccagacaggggaaggcgtgcctgtctggcaaagcgtcagcactatctcactgtgtgtgccggttttcttcactgtcctgtcccgcacgataaggggttcgatatgcagggaacggcaggttttaaaggtgagtaactgcccgttgacatcggcggaaaccggcgtgcctgccgggatgtcaacggtgccctgatgttctccgtcggtgggatgaaactgcatgactgttgtaggcggaatgggactcagggctgacggccagatacgggacagaatgccgtgggtaatttcggggagatcatcctcaattttatcccgtaagcgggcaatcaatagggcaaacgcttcgaaaacacgttcagtatcgggatcatgggatgaggtcagaaaatcggccagatgaggcgactctttcgccacgcgttgagccagttcccgcagataggctctttcttgcaggtacatagactccttgttgtttttcattggatttctctttttattttaatgtaccgatgaataattaatcggcatgttatgcgtaaagtttatataaaatcagcactctgttagaaatggcggcttattgtacgggattattaattagggactgttgatgttttatgttcataaatcaatcagcccacattggtaaccaaacgagagtaaatgccagtgctaacatactggcataatttcgttctaatttatcgtatctcgttgctatagcccgaaaatgttttattctggcaaaggcattctccactaaatgtcggtaacgatataaccctttgtctattggctcttctgattttcggctgttttttcgataaggaatgacgggtgttgcccctgtttgttcgacgatatttctgaaagcgtcactatcatagcctttatctgcaatcacaaaatctgatgccggggagttattcaccagactttccgcatgcttaatgtcgtgcgtttgcccccctgacagttcaaagtggacgggtaaaccctgactgtctacggccaaatgaagtttcgttgaacgtccgccacggcttttgcctatcgcttcctcttcatttgttgctgccccggcactgtgttgatgcgctcgaacaatactgccatcaataaatagccattccctatcagcaagtccagataaccctttgaatatcagatttaaaacgcccttttttgaccacgcattaaaacgcacaaagaccgtattccatcgaccaaattccaacggcaggtcacgccatgggatacctgttctcatccgataaaggatcccctcaaggataagacgatgttcggctttatgataaacgagcccagtgtgttgcattagtgcagatagcttatcccagacgggatctgttaacctagttcgtagcatgatgatgaggcttaatgagtttttggcgaaattgattataccaaatcatcatgctgttcagattaccttcacaaaacgtcaacacgccctagtatgtttaatgaaatttaattttctgatgatttgggaaaaatcttagccactctacccgtcatggtggaaagggcactgagattggagtgttttttcacattctgcaaaaatgaattgtttgctgacttttgtgccggctttcttcacgctgctctgacgttttatgacatggaaaggacacgatgaaaaagccgggtttactgctcctgatgggatggatggtgtcactgtccgtcggtgcaaaaacggtgatctatactgacagtcagcacctgccggttaatttgccccctgagacacgggtcatttggctggatgcaccggagcaacagcaaaggcaaatctttgcacaccttcctgcagactcacaacaggcggcaactcaggcccgggccatacttcagtctcctcagtggcgcgggcaggaacagcaacttatcaacgcttatcgtgctgttgtccatgcctggcaatccggtgtgcgcaaatacccggcggtggtatttgatgatcgtgatgtggtgtatggtacggccgatatggccaaagcgacggcgctcagggagcagcatcagccatgaagacgtcacgctttgcttttccggtggttatcacgctggctgtggcatgtgcgcctgtcacacaagccgccatcaataccgcccaaatcgtggccggcagtgtctcgcccgcctgtattcagtggcgggtcagtggcatttgttactggctgttttgttcctggcacggctgcacggtgaaaacctcggtcaaagtgacccatttcctgccgcaggcggtggtctccacctatcatgcgcccggtgggaacccgtggtcagaaatggcgcaaatcagcccgttatccggcggactggaaaatgcggtgacgggggcgttatccggcctgaccaccggaggcggcaatcacacggttcagattgccgggaagcagagttcccgtctgcgtttcaaatacgctgatgctatcgggcatcccgctaccactctgattggcggacaaatcccggggtattcctgtcgcagtgcggccacaccgctgatgccttattttctgagtacgctggatactgtcgcgtggcgcagcgggctgccggagtcgctttatcctgaagcacttatccccggtctgcgagaactgggcagccagccggcgggcaatatgtggggcaatctctacccccgttccggttttgtcacgcaggttgatgaggataaagccgctgccgtggtggcacagcgggtggcggacattatcacccgtaccgggcagccccatgtttatcagccactggccgggcaacgccgtgacggctactggccgccggccccggttaccgaaaataccggcacgaaaaatcaccaatggcaacggttgtcaccacagttaagtcagtcctgtgcagtattcccggatggccgccacacagcggcggcagacagcaatcaggcgtatgccctgtggcagccctacagctgttgccagcggcgcgggcaacgttttctcggcagtacggacatataaggaaaaaacaggatgataagaaaaccgggactgctgattgcgggcgggctggcactcgctaccgctcaggttcaggcatcagaactgtcggtttccttaccggccgtcagtcacagtgcactggggtatggtgcacaaagcagcggggcggtctccgatacgctgttctacaccctcggtggcggctcggtgatttctgagccggccagtcgcgcggggtcaaccaggctggccgggctggaactcggctggcgttcggatttgatgtgcggcaattttgacctgaaaaccacggtcagtaatcagctcaacggtatcacggcgggcatgaaaaatctgatgagcgaagtcattcagggtgccaccggggcggtcgccagtctccccgccatgataatccagcgggccaatccggggctatatgacatgctgaccaatggcgttttgcaggccaatgtcgcgttcgacaaagcccagttcaactgccagaacatggccaagcggatgggggattttgcgcaaaacaataaatggacgcagtctgcggcgatgcaggaatacaaggcacaggttaacagcggggatgctgacgcggtgcgggccaataacgccggcaccaaagccaccgggacgggcgggcatccgtggattggcggccggaagcagggaggaaaagggcagagcgccattcgaccgacccgtgatttagccagcgccgggtttaatatgatgaaccatcagccggtactgagcactgctaccatccggcatcaggattgcagcggcagcagctgcaccaaattcagcagtgcgcgtgaggcggcagaagccgtcgtcaacgtattgggcgaccgggcaatacgtacttgtgccaacgcggcggagtgcatcagcggcggcgaggcgcaccaaccgggcgcgacggttgccggcacgggttttgcacccatgctggaagcacagactcaggccaatatggaacagctggtgaagctggtcaacgggacggaaaaagtgacggcggcaaatctggccaaactgaaaaccggcagcctgacggtcacccagggcgtgatccaggcattgcaacgtgatccggacaatgccgcgctgacggcacgtctggcgggtgaactggcgatggcagagaccacggagacggcattgctgatgcgtcggatgcttattaccggcatgtccgaacccaatgccgccgcgcaggccgaagccctcaatgagggcgaacggcggattgcggcgctggacagggaaatcaatgccctgaaaaatgaaatgacattgaaacgcgaactggcacacaacgccatcctgaccattattgagcgggaaaaccaccggattgaaacacatccgcagaaacacgtgacggaaagcagtgataagcgtttctatcaactggaaaatccggcaaaccgggtgacgggaaggtaagtgatgaccggtaacgcaaaagcatcgtccaggctgaaaaaaggcgctggcatcgtgctggctattgcggcagtgataatccttacgttgctgacgggctgggcagggatgcgctatcccgaacacctgttcgcctttcgtcaccggatggaaaaccatcaatcgctgtggctggtctggcggttaagcctttatgcgctgttgggctggggcagccggaagatttttcaggcaacgcaacataaacccgcgtaccggacaccgttgatccgtatgatgacggccagtctgctgtttatcctgctgtgtgaatacgccctgtcaggcagcatggggggcagcgcatgacgacaaacagttatctggaatactttctgaccctgctcggctgggtggtgaataatggcctgtggcaggtactgattgccaccgggctgtttaccgtgccgttgttgtttaaaatcatggcgctgtggctgaaaatccgtgaagacagcgtggaagaaggcaatgcggggctccagtcgctctcccgtctcgaaaatatcctgtacggggcgttctttgtcatgatcgcctgttgcgtcccgctggttcaggtgagcctcagtaccctgcaatatgatccgtcccgggccaaaacctgcggcacctggacgccgaaatcaccgcaggaaacggggtatgccccggtgatttccagtctgggcgaacacacggctgccgtgccggtctggtgggcggtggtgcaccggttatcgaaaggactaacccaggcggcgattgcttccgtgccctgccggccggatttgcggcaactgcgttttgaggtgcagcacacccgtattgccaacgccgcactggcagcagaattgcaggattttacccacgattgctatgccctggcgctttatcagtggaaacaacgcgatcagggacaaactggtgatcccgcggtgctgcaggatatcgactggctggggagtcagaccttcctgtcaggggattacactaccctgcaatcacgcacaccccgggcacattttccgtggatggcgagccgggacagcggccggcccgataccggccggggcggctatccgacctgtaaagtctggtggtcagccccgcaaaccggactggaagcccgggtgctggcacaggccgatccggggctgtggctgcgtttgtcggcagccctgaaaatgctgggcaagggaagccgtgaatataaagaggcggtgatccgtcgtctggtcagtccggtcaacctgacggtatcacaggaggggtatgtctacgcgggttatggcggtaatgccgattttacggtctggaacggctctaaccgggccggggcctctgcgggggtgatgttgggtggcctgcttgcttacccgatgctggatgccgtgcggcaggcgctgccgatggtgcaggccgttctcctgatggcgctgtatatcctgctgccgttgatcctgctgttggctgcctatgaatttaagaccgtcctgacgctgacatttgtgatttttgcgctgaatttcctcaccttctggtgggagctggcccgctggctggacagttacctgttggatgcgctgtacggttcagaaacccacagcctgtttaatctggccgggttgcagaacacctcggatgatttaatcatggcgctggtgatggggatgctgtttattgtcctgccgatggtctggctgggtgcactggcctgggcgggggtgagaatgggcgatatcagcggcatgatgaaccagggcgtgggacaggtcaggcagtcagccgggatgttcggacagatagtgatgcagaagatgatgtcgaaaggaaagtagtcaagccaggggaaaacttaagggacagggcgttatcccttaagcagagtgtgaatggtgtgtgagttttattttttcgcctgtttaacctgtttatcattgtcccgataattaaatatcagataaatattcttaacggtgcaggtcagtgagttatttaaataacattccaaaatagtgctacaccttgtacaacgtaagccctttgtattcaaatggttgaaggcactatgtgtagcagcattatgaaatcctatttaatgcaaatatattattgaattaatatattatttttcttaattcagggcggttttatattccttttctgttttttcatattggaattgtattaactcaatattcatgaagtacatcacaaaaagcaaataacttaatgtcatttcattcaatatgacttacactaaaaacgttatacttgagatgttctattacattaactctcttgtttttggtagtagacaatttatagaagcctcaatggtcgaagccattgaggcttcgccgtttatgataatgaaaataaacaaggccggacccggcttacctattcagtttagttttttcgctattgaattaataatgaaatcggttaaattggaacatctttaatatattctaaaatggatcagggaaagtgatgagcgataccgataaaaaggataagagcaagaaaattcaaaaacaatccagtcattttattccttataaaacgacgtatgatttgcgtttaaataaaagagaacccaatttaatcaacatactgatgcagattcagggttatgaatatggctttttgacggtgttaggtgtccgccctttatcgcaacggggtaaccataaaaacagtgccatctatgtcgtgcggtgccggtgtggtaaatacgccgtcaggacgctcaaggcaatcagaaatccggctaatgtgactgacatgtgtgagcattgtcttcacctgtacaacctgaggcgcagaaacctctttctcactgagggaaaagaggttggtttgtcagagttaaccggtattaaatataaaaaacctttataaattaaagaataaggaagccagattgcgcttcgacgttgaatgcccagcatacaccttattctctctccgtaagatcagtttgtcagagatgataaaagggacatttgacccggcctgatacaaaggctaccatcctaaatgtgactacctgtgatctgatcgcctgcaaggatcacctcttctgagtggcgaaaacaaaactctcgtagcctgcaagggagagcaagattgcggtacatctgcgcacttttggaagcagatatcgtcagacaacaaccctccgtccggcgatgaaagttacccggtgttattcacaaccggcttatcacgcaatacgggcagagcattctttgcctcgttccgaaaaacattaacctgcgttttgaacactgacgataaacgtcctgatctctgtacagcgattgcgcgaaaagatcagagggcgtcaatgatttcagcgtccactgttatgcggcgtcacttgcgtaacagcgcagcgattaccaagtgacgccgcaaagcggccaacgtccagagcacgtccggtctggctttacgaccgatttgaaccctgcattactcagtgaaaccactaaaaatagaccattaaccaccctgttgtttgattgataaacgatcgtcatatctgattttcaacccactgcctgatagcaggctgatgcagtaaaaattaaggagaaattcatcacgtcaagataatgaggcgttcatcctgagctgatcagaccctgaacggggagcatgtcatcgctgtgctgagcacgtcgcgagctcctgcaataactcaacacaatcccgccctgctacacattgtctgacgcaccacggaacggtgaacctgaaccgacacgcagggaattgttttaaaaacgactaaaaatgaaaaagtagcaagagaggcgggaatggcgcagggatcgacacgttcaaaggttgagctgttcagaaaagcctttatcacgcatgcccgacaggcgggcggaagttttgttacggtggcggatcgtgagcgtatggcccggcagttccttgattatttgaaaaacaatggcatcaaactccggcaaatggatagcctgaaggtgaaatatattgagcgctatatggctgagcgcaaagccaacaatctcagtcaccggacactgcaaaatgaaatgtcggtgctgcgagctattttaacgcaggccggaaagcacaagctggctgatcccgagaatgaccgtctgagtaaccgggcattgggtatcgctgagacgagccgcaagggaacaaaaattacgctgacaccggctgcattccgggacatttttcagcaggtggagcaaaaagaccggagcgtggcagcggtgatgcaactggcgtatgtgctggggctgcgcaccaaagaagcggtggaagcctacaaatcgttagcgacctggaagaaagcactggaaaacgggcatacgtctgtgcgggtggtgttcggtactaaaggtggacggtctcgacagacgaccatattggatcgggcagcgctgcaacatgccattgcctatgcggagcaagagcaggcaggacatagcggcaaactgattgataagccgactatcactcaggccatagaccgttaccgctatattgtcagacgtgcaggactgagcggcaataaagcgccacacagtatgcgttatcattttgctcagcaatccggagagcattatatagcgcaaggattcagtgagcgggaagcgctggcactggtctcgatggatttaggacatggtgacgggcgaggacgttatattcggcaggtgtattaccagaatattgagggtgaataagttgtattggagcacacagggtctgcttctctggtcattggaatatgagcaaagcaatcttgaatcttaggttattattaatatgttatcgataactcgcttctggacataaatcatttagagtaaaacccgaataaatccaattattcgggttctagtcttaatgaataaagacaaacgtgaatggttagctcataaagtgactaattatgcaaaatacatttaactctatcgaatgtagcgtatctaatctgtggcaccctgcaaaataaactcccgcagtagcttgttcagttcaatattgactttaggtggcgttagctttgtgcctaatttatcttctagataggccttagctttggctttatccactgttgccttaagtgcatcaaaacgaccataatcgtttaagttagcggcggtgagatttcctttcgttagttttttaagctgcttaccatcaagtcccaaagcatcgaccattacctgcaaggctttatcttcttcctctgcttgagcacgggtaatgtaatcctgtaaggatctgcctgcttcgatgattaaattacctgcttgtacatcaagcagtagcttgtttgcctgtttttgttccgcttggcttaaggtagcaaaggatttatgcagttcatcaagcgtttgttgcatctcctctgacgtgacattcggttgatcgcattgcttaagaaatttggtgaactgagcgttcatatagttatgatcaattcgccccgtgttttgcttggttaaatagcccaaaatggcataaggcacagcaggcgcactgccaccattacccgaagaggatgacaactctttataacgttgtaacatcgcttgatactgattctcatcaaaatcaatatccacggtattacccgtttcttcaaatgaatagctgttttcctgccagttaaaaccttgaacttttgccgcctctaaggttttgctgaactcattaaacaggctggcaaacttagcacgagtctcttcatcttttggtaactgactaaaatcgctgatcttcgcgtttttgaaaatgatttctatttcggcaaatttttcattgagagaatgtaagttatcttccaatttctccacaaatacaccataaggacggtctccagaatagagtttgagcgctttattgatgttgagttccatagtgtgcggtttgcgataataacggatgttgccaaaaggtttatcgataccaaacaatcggttagtgcgagaaaacgcttgaatgatatttgcatactcaagttctttatccaaatacagggtattcacccatttggagtcataaccggtgagcatctgagcaacaacaatcagtaaatgtaattgctggtccggttgttgttcgacatattgataaggctttttgtgtgcaagacgtgtcgcaatatcctttttaaattgcgcatgagtgggtaaggtataggtcgtattgtaggttttgttatagtcctcaataacctcaactaacccagcctctttagtcacggcgttacctttgttatcaagattaggatcaaacaacgctgttatcttcagttgaggagcttgctgtttgaataatcgataatactgtaaggcatcagtaatactgtgtgtggcaaaaatgccatgaaattgattaccacggctaaaacgtacccagttagccagaatatcattaatgacttgctgtttatgctctatgcgatcatattgcgtggcaggcagtaattcttcaatgcctcgcacttttttaccattgatttcttgggtcgccattggcactcgagcactgtccatgtacttttcataaattttagtttttgcagtgtcagcaaacacttcagcaacactcgttgctttggctttttcaagcgcaaccgcctcgcgtaagtcatcatcacgatacgtcatcactttgcaagggtcgaaccccagcacgttaccatctcgaataccatccgcaatgctataacgatgtaactcatcaccaaaaatcgtactggttgtgctgtccttcttctggttttcttcttggattggcgttcccgtaaagccaaagaacaccgcattagggaaagtggctttgatgatagaaagcatatcgccaaaggttgatcgatgggcttcgtcgacaatgaacacaatgcgcttttgattaatacagtcgatatccgcagtttttaattgtccttcatcgtggatgttgctcatcttttgaattgaagtcacaatcaagccatcgcttggctttatgcttttcagtttggcgatcagaacatgggtattttctgttccttgcacatcatcactggcatcggcaaagctacgatattcttctaaggattgtgttcctaactcgatgcggtccatcaaaaacaccactttatcggcatcgccagagttagcaatcagttgcgcagacttaaagctggtcatggttttacccgagccagtggtatgccaaatgtagccacctttatttttaatagaccagtccaggctggcgactttacttgaaatagcattcgcagcgtaatactgatagctgcgcatcactttaagaatgccatcggcattgtcggcaacggtataaaaaccaattaactggtgagccatcgggatggatagtaacccttcgatcactttctgccagtggttgatgggttcattagaaaaatcggcccactggaagtggtaatcatgattaaagatcccgtcctttccagggttagcaaaatacaaggtgttatctggattcattgcaacaaacacctgcactaacgccatgatgccgccgctaaaatgcccttcatgtgtgtatttttctatctggttacacgcttcaatcactgggacgccagaacgtttgagttcaaggtggataacgggcatgccattaatcagcaacaaaagatcaccgcgcctatcgtgctggacggcacttttgcgctcaaatcgaggttgctgaacaatttgataccggcttttccccgcggctatttcttggcggtcgtaaatattgagactgatctctttgccatagtgcaaagtgtctgcggcattgtcacgtttaatagagaccgttttaccgttaataaaaccgtttagtttgagaggtgttttaagcgcaatgatttgctctataatttgctgcacctcactctggctgagtggcacattgtttaggcgatcaatactgttgttattttgataaagaatatccgcccaatttttcagcaaatcggtttcggtgaggttggttaagaccttatcttcccagccttttttgcatagttcagtgataacatcttgttcaaattgggcttcactagtgtaggtcacagcttatccttagcgtacagttttaaactcggtcacctcgcgcttactaaaggtaacacaaaaaattgacatcagagtgcgccccaacccaacgttatgagcgcacccatattgggtattaattcagtgcttaaacaaacattttttctaagcacgcttgcttaatatttttcagcttattaatgtgttgctgttgaagttctattaagcgatcgaggttttgaaaatacttgccaattttagtttgttctcttaatgaacaggaaatgacaggaatcccattaattgcaacttttgataaactaggtacgccagttgactcatctttatctttccaatttactttctgaaaaagagcatatgtaaattgtaattcattgtttaatttaggaactgagtagaacaatgtgtcgacggtccaaaatggcgctctaagaacgaatgggcgatcaattgtcccttttcgcccaatacctatagcatcttcattataagacagagccttattaacactaagcatatatccgcctgtaccatatactgggatgctacctttgtttaagtgtttataatcacgaccacttcggacatcaacaacatcggcaagactagtgggcttccaatcaccgtcacaaccagcaaaacgcacctctggcacttttgcccctgcttttgggaacatcttacccaacattgacttttttaactgctgcaacttggtgtgtttggattgatggagctttagttgttgatcgatatgttggaaaaaagtaccgatttgggtttgttctttgagtcccggtattttgatttcaaactgtccgtactcatttgcattaacacctggttgaccagaacgttgagacatgacttttataaaccgctcataatcataagtcagcgtgttctgaaaaataaaacgaacatcatgatctggtctaatttttgctctgattaaaaatcctgcgtagtaaactaacccatccgtttgtttataataataggttttaccaacacttgcccctgttcttgcaaataacaaatcgccatattcaagcttataattatctgcaagagcaaggtttgtttctggtgtagttaatgaatctttatcaaactcacgagtatcatcattgatatcagtaatacgaatatacttatgaacaccatcatatttaacagcacttgcatttagtccatactcaaatgatagggctatttggctcagtggtaattcttgccaatcaccttcaaaacgattgaaacgcagagcaggttgaaacgttttttccttactcatcggtgccaccttgcaacttttcaccaaaaaggaactgttgcagctcttttaagccctgcatatcaaattcattgccttgcagttcgcccatcattgccgccaagctttgctccacttgtcgggtttcttgagcaatatcggcataagtttgtgtatactttcctgccaaagcttccagcttactggttaattgctgcaagacctgatttggcagtttacccagggagttaacaataggttttatccatttaagcagcagtagatgatcaatttcatcttgagttaagttttcgatttttttacgtgttgcttccagcaaagcttcattggcggctttgaggtttaccttcagtgatttatcttctgtttgtaatttgtctacggcaagcaatttgctttcaaagctgtcattatcaagtgtttcgcctttctttttgtcggctttgatttgtttcacttctttgtttagtgttgcgttaacaaatgcggttttgtcgtcattaacatattccgcttctttatcgtcttcgctcagcgaatcgaagatctcctgaacctcagattcgatgctttgcaaacgctctgccatgatttggatttttgctaggtcttctacaaagtaggttttttcaaccaacgcaaaggggaagatgcgaccaaaccaaccgtcttgaacctgaacgtctttgcctttttgctttttggttaccatattcggttcaactactttacaggtattcataccttcggtttggatcatttccaaatccgcactgagttgctgccattgatcatcaagcaattgataagcatcgtatttatcaatcagtgcgatcccttctaaacggcggaaaatctcttcactgatgatatcttgttggcgcgaaggtttgacttgtaacagctctttaatcaagctctttgtcaaataagcctcaaaatcactaaaagctttttgatacgttgccataaattgctgcacatcacagtcagcttcaatctctgctctcacatcggcaacttttaatgctgagtaattactggatgttagtttaaacaggcttgccttgaggttaggcatcgattgccaatagtgttttagcgcatccagttcgttattagggataccaccaaacatagaggcgtaaatatcccaactttccgctgcatctgaagaatccacataacgcggaatattgaggttataaccattatcgcgaatggtgtcacggctaactaaggctgcaaatttttcctgtggtttacgagtgaccacagcatccacaatacgttttatgtcgcaagcgcgaagtttgttgttcttaccctctttgacgaacccttttgaggcgtcgatgatcaatacatcgtcattgttacgtgtttgcttaagcaccaaaataatggttggaatgcccgtaccgaagaagatatttgccggtaagccgataatggcatcaatatgattcttttcaatgaggttctcacggatctttctttcatcaccaccacggaataataccccgtgtggtaaaacgatggtcataatgccatcgggtttcaagtggtacagatcgtgtagcaagaatgcataatctgccttcgtttttggcgctaaaccaaaaggcgaatagcgagggtctttgtctttaaattctgggtcccacttttgtgaataaggagggttagagacaaccgcatccacacgcatcggttcatgggttttatcttcatccagaggccaatcgtcttcgagtgtatcggcgttacgggtgatgatgttatttggcaaaataccacgcataaacaagttcatacgagttaagttataggtgttttgcttgagctcttgcgcgtaataacggatgttattttcaccatcaagacgtctttctaccgattgaccgatgttgatcaacagagaaccggaaccactggttggatcgtaaattttgatatgtttgtggtttttcaggtgctcagccataatttctgacatcaataccgagacttcatggggagtgtagaattctccggcttttttccccgcattcgcagcaaacgaactgatcaggtattcgtagataaaaccaagcacatcataatcatgcttgtctttcatcggaataccatcaatcaggtgaatcagattcatcgccgctttggtttgtgctgctgcactttcacccaacttgcttagtcctgtttccagggtagtaaaaataccgtcaaacaagtctttatgatctggattaatcaagcggctgaacgccgataacgcatcacgcacataagcaatgtcgaaatctttaccatcactgatccaagttgagaacagattgtcataagcgatgaagtaacctaattcgtcttgaatgtatttgagggtgtcggtatcgccctcattcaattctttgatcgattgctcatcaaattcgttttggattaagaactgaatttgcttatcagacaaaaatttataaaaaatgaagcctaagatataatctttgtaatcgtttgcttcgattttagaacgcatttggttagccgattcccaaatcttggcggccagttgttgtttattcatgttttactctaattactattcatcaatgactgagcaatgcgcttaaatgaggcaaagcaggtatcgaaatcgggtgtttctgtatcaaacaccattggggtgacaaagtctgtaaaccttttacgaaacagctgattagactctagttcttgcaaacctagctgtaattcttggacagggttggcaacaaactccgcatgctgattaccaaatcgcataacgtcttcttgtaacacggtttggaaaaggggcataagagtttcaaaatcaagtttctgctctgcgtcaatacaatgtacatcgtagatatggcgtatcaacgtagcatcatctttgcgctcaaaatctcgtttgactagcatggtacggcgcagcatagaaatgactttctccaccaaagtggattgaacggagatacaagaaaatgcgttgacttcgtgaggctgatgatacagctcagcaaccagtgattgaatgctacgctgttctatttgaagcagaggtatggtctccatgagttccagtttaatgattgggcgcaagcaaggtgcttgtctaaattgctgtgggtatttcagttcatattcgacgtagcggtattcatcacgggcttttttttctttaatagaaaaatggcttgattggtgagttagagatttttctatttgttgcaccagagctttacgtgtcgccttgcgcttgtcacgaccgaatgagttaaatgcatccgttgggatgagtttgatgtcgacatcttccgacatcctgaggatttttacattggatttagccagtgccgtcccgccagaaaagaccatttgatgcgtatcaaaagcaagctttgctaactcagcaagcaaagccactacccagtaatctttttcaataatggctgggtttccgagctctaaggcatcggaaacctctaagaattgatcttttaattttttcatttttaacttggtgagttaagtacgcgattaccaacaaccagcttgcgattaaattgcttaggattccacgaatactgcacagatgaagggatttgtgtgctattaccggaaagactttgcaacgatagactatctacttcgaagtctacgcctttcatcttaagaatttcacgtaaaatcgcatcggtgccaccaggattcgttggcattaggcgacctgtgaggctgttcttacgtgctttagtatacaggccatatccgattttcatcagttcaccttgcttgatcaattgattaagcgcacggccgatctggtcataactggcaatgtcttcaaaatctttgcgttcaaagacgtaacgtctcgaacgtttcaacttttgattgattcgatctgctgctgtcataggacctccttctttatgtataggaagtatacactagaggaaataaaacaggaataaatacgacatcatctcaagaatagatacggcattaaaactaaaataatatttttaaaatattgatttatggcaaatattgttaattttaatgaatgtcatatcgaaatattaaacataatgaccttgtttatgaatcaatattttcggatagtttcagagcatcttcaatttcaacacccaaataccgaattgtgttatcgagtttgacatgcccgagtaagagctgaactgcccgaatatttttagttctggcataaatcaaagttgctttggttcttctcatcgaatgagttccatatagatattcatcatacccaggttctcttgcctatcgtcgaattatgctggcgtaataactataactcataggattaccgattttacggggactgggaaaaagataatcagaagtagttaaccttcgaagtgatacccacagtgtaatggattgcgctgttcttgaggttatttcaaattgaacatcgcgatcagtcttgttttgccgataaaacactctgttaatggataacaccattcctactaatatcatgaactttgatcctgagtagatcacatgatctcaacttgctatcaatagctaagttggtgaaatcaatttattgaatattcacttaatttctatccttgttctgatccgccagatatcttcgagcccaaatggctttttttgactggttggatgacctttttttagtccacatggcattttcctagtgaagctattaattggccttaaaagtttagctaaaaattgagggaatgagtaaacacataactattcaaataggaaatagaatttttcatcatgtaaagcctaatggtagtggttggcttaaatgattatggggcagaaacatgctggcgatgatcatgccccgatatgtccttgggcataaatgagttaacccaaaggtaggtaacgatctgacgatgatgagaaaatatatggctaactgccaggtcaagttcgagtgacgactaatacacttcaatattgcctactatgtctcatttttaaatattccctttgatagttatggatttcattaatatgattaatacttgatgtgttgagggataactacgccattaactggacttagtccgaggaaagagaaatctttctacccttttacccccacatgcctagcttctctatattagtgacagcatgaacatgggtgggtactcgaaccttttgggcgaccaaaggttcgtcgagacgggggctttgtgctgatcaatcccttcctttgtgaggcgaacttgtaacttcttaatctcatctgcggatgaggtgggtttcaaggcacataggagatatttatgaaaaaacataacgcacatcaagatcagcaagtaaaccaaaagacacgcccgaagaagtgggaaaccgttttttcaatcattaagttcatactcgtatggatttatagaatctggctcttactacgtatgttagaaggaacagaaaggggtgacgagtaagtttactcccccttgtttcgaacctactatggactacctaatgatccacaaagctttaaaattaattcgacaatatcatgaactaacggttagcgatttagctaacgagtttggtttgacgccgttgtatttaaaagaacttgaatcaggtaataggcctatcgagagcgaattacttgagatgtattcatcaaagtttgatatccccgtaacttctcttgtaatgttttctcagaacatccacaaggaagggaagttagccaaaaaattcagacaattaatggttggtaaagttctagtaattgcagactgggcgatcaataaaaatgacaaaaaaatcaaagcttaaaatagttaccagaaaaaaatcctataccttacaagattctcctttctacaaacttaagtcaaaaaagaagttaacaaatctactcaaagttgatatggaaactctgcttcgtatgatgaacgatacggaaaactacaacgagtttgaggaaaaaggtaagaagggtaaggtacgtaaaatacagcatccagtaggcgaattagatgtagttcacacacggatcgcaagtctaatttgccgaattgctacaccgagttttttgcattctggaaagaaacaacactcaaatgtaggtaatgctcgtattcactgtaacagttttccactcatgacaacggatgtttgttctttttttccatcgacaaaaagaagcatggttttttcgtttttctacacagttatggaatgttcatcagatgtcgcagatatcttaagccatatttgcacaattcacggtcaccttccaacaggtagtcgcatcagtatgccactcgcttactgggctaactgtagaatgtttagcgagctcgaacagttagctattaagcacaatgtaacaatgactttgtatgtcgatgaccttactttctcgggaaaccacgtaaacccacttttcaagtccataactcgtcagattattgaaaggcatggacaccaaatgcacccgaccaaaacaaaattgtatcgcggcaaagaaccgaagcttgtaacaggcattgtgataaaggatgaaatagtgttcgtacgtaatgagcagcgaatgaagctagtttcagacattacatgttggaaatctataaaagacattcctaatgccatcaatatgcagattacactcacattactaggtagattgtatgcactaagttctattgaccctaagttcaaagatagagccagaactattaaggccaacactcaaaaataatatttgtatctacctattatacttaattttttcttggtagtttaagattaagaataggataaggctttacatatccattagctttggtatgaataagcacgaaaagggaggattggtaaatcttggatctaactcgtaatgggtggtggccccctataattcctgtctcttgatcagatctccaaatcaaccgatttagccagcaaatagccgtctatcagggtttgcagccgaaaccaaccttcccaaagtcgttcccatccgactcgacccgtgcgtttggaatcgtaccagccggccagttttcccagattgatgaaggcccaatgcaagctcggggcttttttcggtggacgccgtttttcttgttttgaccacagtaatttccacgccagggggcttaatactgtctcacagctctctttctctgcctcttctttgttcagacccataaaacggagcgggtgtatccgtaccgcaataaaggccagcagcactatcatgcgctccagattatctttgctttgcatacgcagcgcttctacctgcgtgccgcccgttttccatgctttgtgaaattcttctatcagccagcggcgctcgtaataactgaatattttatgggcgtcttcctgactgttgacgggttcggaggtcagaagatgccagcaaagcccatcctccgtacctttttcgtagcaaccgacataaaatatccgcaccgcttcaccgctttttccttcggggattttcaacgtcacttcggcataactgatatcacaatgcgcgacacgcgcctgacgcccgcctttctgtctgacctgaactaaccgtgctccagcactctgtaactgactgataaagtcataaagtctatcctgactttcctcaatacgccggctgtgcatcgaacggataacgaaacgttgtttttggctcgttttataacgcagatattcgatgatatcggcttcacggtcacagacagaaatcacgttggccatctgctcccctaaccggctgtcgacggcttgtgaggcccgttcccacttataactctctttcccttcataagggcgtgtgtcgcgttgtcggcttttgccataatcactgacatctcggcaccagcgctgttgctctatcaaccccacgacctgttgttcttcaggtgcaaataacaacaccgagtgtgcctgcatgccccgggattttttcttcgaggtggtataaccgagttcatcggcgaccgacgcatgggaaaatgacagggttgtcgtgtcttccagcgctaacaggcaatgataacgttgagcgtgagcgacggtggcggtaaatccggcttcggcgatggcttgaggcacaatggcggaatttcgggtcagtcggtaggccgcttcaacatcggcaggagagtcaagagattgcacgagcgattgtcctatatggttagccaacgaacaggccactttcaccaggcggttggtacggcgtttatcacctaattccgcgtgttgaaacgtgtcatttgcccattgttcggcgcaggttgaaaacataaagattacctcaagtcgtgttttttattgggatcaatctatgaggtaaaagttcaataacgaggggggggcgggttaaaatatttgtgtaggaaagacagctataattcagggccacatggcttaaccatctgttccttctgaaagtcggagggcatcctccaattcaacaccaagataacggatagtattatctacctttgcgtgcccaagtaatagttgaactgcacgaatgttcttagttttagcgtatacaagcgttgctttcgttctcctcatcgagtgagtgccatagaaatttgggtctaacccaagatttgatgcccacgttctaacgagatgcctatagtatgagtaactaattggttgctgcttacgtctcaaacttgggaaaagataattgccagcagtcaaagaagcagagagcatccacttaattaagctattctgagtcttagaggtaatctcaaattggacttcaatatcagttttcctctgagcatgtctaaccctatcaaataccataccttgtgacgaaacatcgcaaactttgagagtcagcaaatcactcgctcggagtttgctatcgattgccaaattgagtaacgccagttgcatcaggttattttcgatttcgagccttgttcggatatgccagatttcttcgagtctaaaaggctttttgataccactacgtcgacttttgtttgatacgaccataatgatttcctttttgtataattagtcatcatgattgtagtcttttgaagatgggtagatatttgtcagtgctttttatctaacttgtaagacttggacttattgcttcattcagctcgtaaattaaccgcatggatatcctcaatggttgaaaaaatgctaccaaggacgtgatagcatgagatattgagtatggaaaatatacttccacaatgaaaccagggtgaagttaaggttgttatttaaaaatcatccttgctgctcatataggtctttttgatataatcatcttcgaaaatagtgttttcccttgcagtgacgtatttcctaaatcatcggttgctggacataacagaatttctattttattaactccttgaactgatggatgataaataacgaaaaattcattccagtcattccgtgctccagttctaataaattcactatatttaatctcattatcaatgtattctctaattaaaaatgaagactctggggaacccaattcttttacatggcaagagaaataaataatatcatcttccagaacagggattaatgcagcagaatattcccgtactgataatggttctgaatcatctaattcaatagcataaggtataccaataggtctatcatcggatgaggtaccagcaatatttttaagtagtatatccgaattttctatgctgggggggtaattacaaaaatatggttttttgaatctgtaaattatagtgccgttattaattttacaagccatttttccattgataggtggagtgttaattaacaatggatagtcagtagagacaattaaacctgtatcggaatcatgagttacaatatcttcgattgtattaaataaaggtttattcattccgagatttcgctcaaatgaaactccatttttgcaattattaatgctcaagccatttacttttacatttgacgcattaataattctgatggctccattatcaatgttgtttacttgacagttactaatatgtatatttttactttcattacttcctggtaatgaaggatactgatagttagtgattaaaatacccgcgactcccgctcttttatcatccggtgctcctttgaatatagaggatgttacagttatattttccccctgaatttcaaggaagtttttattcctataagactttcctgtttgttctccaatgttatcagaaaaaattccgtctctagagccatcagtagaatggtggcaatcattcatatcatatgtattacataaagaaatgctccacttttcacaaccgcgtttcaaatcggtcaatgttctatgccctcttgctgtatttcctcggcttacaatattgcgtattgtatatattccatactctgatggtgagtctatggagccattcatacatttaaacgcattgaatcctactgaggttttttctgggtcttcgccttcagatgaacaatataaatatcgtataccatctattgttcctccattagttgtgtaaccttcccaggcttcatgaggcatatttttaaagtggcagcgcaatgctgtgatatcagttaaaacagaatctctatctgcatgccaacaaaatcccctgattagtgattccaccttaatttcatatccaccttgatattgaccatccattccaatatcttcaagcatggcgtaagtgagattttgttcgggatcttttcgtgtaaaccacgcataaataccatagccatttgaaccaacggttgctctggttaatgacacaggttttatcgtggtatcaaatcggccggatgagcgccaatgaaaccaatcaccgatagaaatgtaaccatcgaaacatatttctcgaatacctgaaaaatctatcgggatccgcaataattcagatctatcttgtagatcctgtaataatttcctattacaaactccagactcaatgccaaattcttttgcagatattactctgattgaattaaatgattgagatggtaataaagaactatgtatcatttctgacatctatgttactccaaaaaatatttatcctatatgatagtttttaatttattcaaaaatatcttggtttttgctcataaaaccttatttgattattaatggcatttcataaaggatagtgtgattgagttttaaataggtttaattccctgtttataatcaccttaagataccacatgaagttatttttttaattaatcagtcttgtgtgatttcccatacatatgaattgcttaaaaagtaaatgtttcttatctcaatcatatgattaaatatacagctctaactaaataagctttcaaaatagtagatcacttgaagggaactcagtccggtttttgcgatctgattaatcgccaaatcaaaaaaatcccaaaatggactgagtgatgccaatcatagcacccataccccgaagtgaacgacgtcagatgaaaaaatttattcataaaacccgggataaagattatgcacgccgactcatagcactcttaatgttacatgaaggaaaaaccgtttctggcatctccaggacccttcattgttcacgttcttcggttaatcgttggataaattggtttacgttgtatgggctggaaggattaaaaagtttaccatcaggaagacctaccacctggaatttagcgccactttttagtttgctgtcgttcttattacagcactccccgcaggattttggctgcctgcgttcacgttggagcattgagctgattactcgaataatcaatgaattattcggtttgtcgctttcgcaaagtacgttctatcgtgacttctgtcaggtcggtattgtctggcgaagggcagcacctaccgtaaaaaagcctgatcctgagtatgacgaaaaaagggcaaaaatcactgaagctttatccagcgtgtcagaacaacatcctgttttttacgaagatgaagtcgatattgaccttaaccccaaaatcggagcggactggtgtctgaaaggacaacaaaaacgggtcatgacgccgggaaaaaatcaaaaacactaccttgcgggctgccttgacgcccaaacaggccaagtgacttatgtcagcggtataaagaaaaattctgatttatttatcaaaatgttaaaaaaactgaatggccaatatcgccatgcaaaaaacatcacattgattttagataactatggcattcataaaagccggaaagtcagtgcatggctacaacaaaatcctaaatttaatctgttgtttttaccggtctattcgccatggataaataagattgaacgcctatggcaatcattgcatgaaaccgtcacacggaatcattgttgtcagtatatgtggcaactcttgaaatgcgttgaagcgtttattaacgcattttcatcagggcaacaaccgggaatgagaaaaatgagtgtatcactattatgaaaacttatttagatttagattactagatgtaatctaaaacacttgaaatatgctctttcattctctaattccaaagagactcaatatcaatatcgtcactgtctggcctactaccgtcaggcatcacattgaattgaacaaccattgggacatcgaatgatgttcctataattatcgaacaaccctttgaaaggttgggaatcatttgtcgtgagagttcatcaagtgagctaatagtgttctctagcaacttgaggtcacgctcattgactaagcgatgaataaaaaaattatgtagctgagacataatcgtaggtgagatatctgctggcctctgacttgacaaagttaagaagaaaccaaatttacggccttctttgataatttcctcaaatagctccaaacgataatccttccaactctcactttcacgactcgattgggtcgacagtatgttatgagcttcatcaattatcatgtggaatgtttgctctggtggactctggttcataaccttctgcttgtgttcaccataataaaacttagcaagcaaaagtggcataaccttcttaatttcttgattagtccttcgaagtgataccactgacaataacatgtttgctggtcgttcttctctaacgtcaaacacacgatctagtgctgtcaatgacgcttctactctctttagtagaggttgtatatggtcgaactgaacataaccgctaatgaggtcagaaagaagttgagtgttgattctcagttttaactcattgaatggcgataactctctaatgttgatgtcgtctacgtatgctctgcaatgatgattgtacgtaaggtcattatcaccaccattaaaataatttgggtggggggtgtttgggaaatacaaccgagatcgttcaccatgccagcctatttccctaacttttttctctaggtcttgggagccaacaagttttgcaatctcttcaataagagctacaaactctttcttttgtgcggtacttgtgagagcacgctcgatagttgacttgacgtacttctgcaagctatctggattgtctttgaacctgtttcgaccagaaactatccgctttaagaacggcttctgagtattctcagttgctttgaataagatgccgaataattcttcatcccagaatacatcgctagtgagtggaaatttatcgccatcatcattgcgagtatctagttggtataccttcttatacttgtcttttgatattagctggttatttgtgtactctccattaaagtcgataacaacaaagtgactcttgtttatgagcttgtccagcttattgcgaaatagcgttgtgtatatgttagtcagcgtattagatttgccactaccagtattgccgaaaattcctatatgagtgttgaatagctttacccaaggtagcgatataggtatttcttcagtaagcgtttcaccgacaacgaagttgtcgtcaggctttccaaagatagatttaacctgagtgtcactcattaaatacgcaatatcacggatcatcggaaggtgttttatgccttcatggaattcattgaactggaaatgcccaattggtactaactcaactttacggatatagcagccgctctcttcgtcttttagtcgttcatctaggtattcgccttgtactctagcaacgatatccttgaacccacgacgaattaaaatgaactcctggatcgatacaccgttgaatttttcgccgttatagaacaacgtctcgttgttggactcttcgtataattctacagtgatattagtgcctttaactgaaattacttcaccaattgctatactcatttgacaccaccaactacagcttcaagcattggcttcatggtttcttcaggcataggtttgtttagtttatttaccgtgaagtattcatcattgaaaagcgtaaaatctaattttctatcttcggagtaaatcaacttaacattcgggtactttctgaatatttccgacatcctgtctttcgttgactcgtcatagcacattacgtacatagtcaatgacggattagacaatgctcgctgtacaagactgagaatgtgctcgtcggcaaaagagaagccgaaagcaattaatactgaatgagggcgttcaagttcataacttaggtgacgaagaatctgatagtaagcctcttcaaagacggtttcatgaaacttccactttgtggggttcacgataggcattttgttatagtcctgcccaaattgctcagaacgaagtttcgtaaaatctgtgtgagcttcaaatacactcaggtcattgagcgatttatttgtatcataaagaatcaccttgcaagcatctagaatattattttcgtcttgattgaagtctatgttgtaacagctagtaccgtaattaagttcaatatcaccatctttgttgcctttcatccaatgtactgagccgtgagcatgcagaaggtttacttgaggaagaaactgttcgtgacggtcaaacacgcctttatttacgatacggttattgaagtttcttgtgtggaaagtacgcgcttgaaaaccagtgctgccatcattaacttcgaactgagatgttctttctgccatcaactcttcgctagcaatttcaaagcaattatcgtagttagttgtgaaaatgtttgcttttttggctgatggtttttgcttgtttaagaggtgaatcaaagtggtcatgaaccgcttatattcttgaatgacgctttcttcatgtggcggtctaggaggagcaggaatacctttggctggaactgagggtaaaccaggcttaatacattctcggtagtacaacatgaacagcagtgttgtcatttctttgttgctttcatatttctttgcaagtgtctcgaatgtgcacttactaccatctagcccctttacctctagtgctaacgtcggtagaaaaccatttgaagcaccagcaccgacaagaaagttcaggttatgatcgtagatttgatgtaagttaaattcagcagtcatttaaatctatttccaagaataagtcatgtcgatagaaagactgaatagccaccgaatcagaagacacaggctggccacacagatacaaaacttaacacatattgattcattagctaaatttggtcaaagagaaaagctaaagcgtatgactttttggagcataaaacagtttggggcaaaagcgagttagttgtaccaatgtgattaccaaataagactcgatctgacactattgatgatctgagctagacctaatctgatgagatggatgccctgtatggcgtcaattgtaccaaaatgaaataaatatattgtgagatctctgacttcgactgacagatcatttttagctatttaaattgaacgcttaagtgtttactgttccattgttcccgaaatccctatgaactgtatattttgtctcccgttattaaatgaaaaggattcagttatggatattcgaactactctccgggctgcgagtctttctctcgctcttgtaagtacggttactgttgccaatgaagccctggtgtttcagacagatttcggcctaaaagatggggcagtatcggttatgaaagggatatctttcaaggtgaatcctagccagcctatttatgatctaacacatgaaattccaccttataatatttgggaagcttcatatcgcctttaccagactctaccatactggcccaaagggactgtctttgtaagcgtggtggatccgggagtgggcactgacaggcgctcagtggttctcaagacacagagtggtcattacatagtctcaccggataacggaacattgaccttggtagctgaacactttggtattgaatctgtacgtcagattgacgagaagttcaaccgtgtacctggctctgaaaaatcatatacttttcatggacgtgatgtatacgcatatactggggcacgacttgcttcaggtattattagctatgaacaggtggggccgctgttaccaaataaagtagtaaagatcccttatcagactggtgtagctgaaagggatggaactcttaaggggactattccagttctagatgtacggtttgggaatgtctggagtaatatcaatgacagccaggtcagtaaggtgggtattcacaaaggggatcaggtctgcattaaaataagtgaaggggataagatccggtatgaaggcaaagccccatatgtcagcagctttggtgaagttcctgaaggtcaacctttggtgtatctcaacagcctgctacaggtatcggtagcactcaatatggataacttcgctgccagataccaagtgcagtctggtgataactggcgcatcagcctaaaaaagtgctcagattaaagggaactggcaactacacaaaatgctaattaaggtctgggttttccactatatttacatgcacctttgattacttaacccatgactggtctggcgcagcaggtattcccgtggcgaacggtcagtacactgtgcagatgctgcccgctcaaagaatctcgggcagttttgagcgaatagccgacttaacttaacatattactatggtgcaaacttacgttgtgtttcggttatgcaccataaagccaattagttgagtctttcttattaactcttttaattagtcattagattttctaggtgaccccatccagtttaacttttttaacaggagtagtgtgcaacacattttggggcataaatgatttagacaaacgaccagaacgggtcacctcgtattgacagcctctctctgactcccccaaaatcccgtcgtgttcctgacattattttttgtcccgagaaatgaattacccattgacctaatgatttccgtttattagcgtagtcagacttatccatgatccggtcgcttgtgaggatcaccttcgggcagcgacagcaacactcctgtagcctgcaagggagtacacactgtgtggtacatctgcgcacctttggaagcagatatcgtcagtctgatgacgatgaaggtctcttaatctcatccatgatggccaacaggccagtcacccaacggggaacacatttcccattgggtcaggtgttctccgttgttttatcaggagaataccatgcaacaaaatacaatcccggccacggtgcacactgtgtccccggctgaattatccccttttgctgaaatttttccgcacaccggttcactggaactgatgctgctggagcacacgttcattaaagctgctgctgtgctttgtgacgatgaccggtgtgaccgatggcagtaccggaaagtgtcagacagcatcgcctatatcgtgccgatgcggccggattcttctgtggttaacgtggatacgactgactttaaaggtgaagtctccgccgatgcctttggactgatggtgaccctgagcgtgttgggttatctggcggccctgatgaagctggacgggtacgctgaacggttttgcgacctgcgtgaatatgcgctgcaacatcctcaggcttcgtgtatccgggctgctttgggcttaaagggtgcataacaggagaacgtgatgccaaataatgaactgattatgctggacagtcttgcgctgtcggtcgtgtttcccgacaaaaccccgctggaacggttgtttctgggattcctgctggcgaataccgcatcgacgttatgcggcgattatcagcctgaacagtggacaagccgacaggtgtctgaatcgctgacttatatggtgccgacacgggcaaaaacgtattccgtttacctgccggttacgcagctgacggtcacgctttccgccgatgccttcgggctggcggtcacggccatcgtatcagcccgtatcgcggtgccggatacacagaatgaggaggcgtaccggttctgcgcattgcaggcgtatgcgcagcagcacctggaaagcggcctgatagcctcggtcatgacactgaaacccgaagaggacgttatcagtccgtcacttatccctaacaaaaataatcatcattaacgttatcagcccatgaggctgttaacgcttttcttaagcgcctgaccggggaagccaaaacaccttcccggtatcgggcgggtgttttctttcattgacataaaatcaaggaacaacaccatgaactccatttttttaccggcaccggatgaaaccgataccgcattacgtgaagagctgtttaccgctcaggtcaccggcctgaggcaacacccgaaagcaccacagtcattgccgccggaaaccctgatggtgtgcgaagcctccaccgtcacggaagtggtgcagcggctgaaggtgatccatcttctgggggactggccggtgccggagaggttatctgctcaggttgcgggggctttttttccgctgaccgtcatgatttttgatgcacaggacagaaaagtgctcggtggccggtttgatgaagaaattatctgggcgcagccggtcacactgacgtcagaacgcctgtcattggaacagcaacagcagcggttatgtcaggcagcgatgcttgagcagagctggcagaatactccggcggcgcgtgcgttgtggcacaaggtgcatttattgtcactgcatggggtttcctcctgttatcagcagtgccatgaagtgcgggatattctccggtatggcgtctccgtcagtgctttttctgagggggcatgatggccacattacatttaacggtctggcaggtgattgccgcagccctgttgaaacggcattttggcctgagcctgactgacacggcactgtgtgaaaccgacacggtggcggaactgatagcagggggtgtccggccttctgaagccattaacgaattggtggataaatacgacttaacccggctgaatacgcaggttatcccgcgcagtacgccttatctggatatccacgatgaactgacggtcatttttgacagcggtctggctgaaatgctgttcaggcaaaccaggccgtaacactttttttcaatctacccatcgggggaactgtgccccgaatgggtcggttccgcctgtttatttttatcattcaagtgaggaacttaaccatggcagaatggtgcaccaatcaactggaaatcaccggcaaatccgtctgtctcgatgtgatgcaacagtgggtctgcggggaagaagtccctcgttaccgtcaggcggtgttacaaagcctgcggttatttctggcgggttgtgcgggaatactgaaaccgaccaaaccacaaacctacaccccgtacccagcgctggtgcgcggcacggcggtgccaacggcgcagcatctggcctttgagcagtggttgttgttgttacagaataatgtgccgttgaatacggacaatatcaaacgcattgataacctgtatcgtcagtccggtctcagcctgatgtcctgggacaaggtgccggaagcggcgcgtgatattatggcccgtcttctgacccgccagtataccgactggttcggcatggtgggctggtctgacacacccgatatcggggcatgctgggataagctgaatgcgtacccgcaggcggcacagccctgcgatatgctgatgatgatgtcaacgaatctggcgactgaaatcaacggtaacagcaccctgctgaaaggcattgccacgacagcgcagttttacgatgaacaatacgggatggaatggccgtttggtcaccatgtccgctgggaacgccgcaatgtcagcagcttaaccgtgcggtttgattccccctgggcaccgccttcggcggagctgatgggggagctgtccgcgatgtttgactgtgaaatccgccactggtacagcgaagcatcaggccagctcaaaggctacgattgctatgaccaaggcgagcacgtggacagcggtcacgggcagtcaggacgggaaaaccggccggcactctatctggtcaccggtgagcaggcggaaacggcactggctctgccggctatcgcggttgggcaatagcccttcgtttaacgcagtatccatttatttttacctcaaccgaaaggggaaactattcccttttcggggcgtgttttccttttttcgctttttgttcagcaaggaaaacacgcaatggcatcccgaaccgatcatcagaaagaattcatttcgctgtttaagcaaacggcccgttatcatacccgttatcaggtcttccgggatttttgcaattgtgctatggcagcgatccacaataaacactgtttcagtgaggagctggagcagtattatctgaaaaccattaacaagtacgaacgggccgatgttgaccggatcgtacaattgttttcgcatgtggtgctcggactggcgcaggaacccggtgattttctgggtagtgtgtttatgcggctggaactgggtgataaggatcttcagcagttctttaccccctggagtgtggccagaatgatggtacagatgcagttgcaggatgccgccgggctgttacagacacaaccgtttgtcaccttgtgcgagccgtgctgtggggcgggctgtataactttggccgccgctgaagtgctgagggagctggggcacgatccgttgtgcagtctgtgggtttatgcgattgatattgacccgctggcggccgtgatggcgtatattcaattatccctgaccggtattccggccgccgtcaccatcggcaatgccctgcatgatggtggtgacaagcgaacccgttatacgcccgcgcattatctgggcaactggtctcagcgtttgcgggaggcggagcttatcgccgcctgaacgcatttttttaacgatgactattgcgcctttcggggcgcttttttttgtttttaaatggtgttaatacaatgggttatggtgaaaattaagctgattttgtcagtcagtcaggggatgaaccgggtcagattaattttcatttttgcaaaaagagttgttccttgtttccggccgggattcaccgacactgagccaaatctgaaccgaaagaggaaaaccatgtttcagcgttttaaatcccgttttacccgtgacctttccccgtcacaaaaagcgcccggactagcgcctgaaagagtacgcggtgccggaggttatttccgtccacagtcagcagaggtgctgctggtaacttcagagcgtggccagtatctccgccaactgtgggaaaacagtgcgctgcccgccgggttgtatcagcaattctatctggatccgctccggcaattatgcgcccgtgtgcagcatgttcccgcgacacaagagggcatctggtcttatcgcggcggatttatcgatctgaccctgcaatttactgcctgtgccgtgcggctggcaaaagggcatatgttgcctccgggggtggcgccggaaacacaggccgcacaaagtctgctgtggcagtcggtggtgttctgggcggcgctgttttaccacctgcctctgctgcggcaactggaaggggaactggaagacgggcatcactggcagccgggattgtggatacctgaacgtcgtttccgcttccggtttcaggcaccgcggcctgagctgccagtcctttataaaacgttgctggctgcccgtttgttaccggaggaagcggtgacctggttgtctttagtgcccggtgcgtggcagtgcctgatgttgcatcttggcggacatccgtcttctgtcccgttgacggactcactgcttcagtctgccgctgagcaggtgcagtcaccgctgctgaatcccgttgaatctgctaaaccggctaccgataccaggctgtcatcatcagaacccgatccggttattccgcctgtcacaccgggaacagtccctgcgcccgacaccaccgaggatacccggagattactgtcattgtttcaggcagaggaatgaaattttgatgagaaagaatgcaaatggtaacgataacgattcgaaattgtccgaacgcaccgcatcagcgccggaaggccttgtttctgcaatgtacaaaaggtcattatatgaaaaatgaaataattcaacgtgttaattaatctttcagtttattaacgggacatttctgtaccgggacacaatattacacactaaggaaacaacaatatgttaaataatgaggaaaaaatgggctgggatgcgttactggacgagtattttttttcacggatgttacggccggcaaccgaatggagttatcgcaaggtggtgcgggtctttatccggtatatgggggaaacggggttgccggagagcgtgactcaccgggatgtcctgtgctggcggcgtcatctgctgatggaaaaaaatcagtccggctatacgtggaacaataaggtggcgcacctgcgggccatttttaatttcgggatggaaagaaaactgttgtcacaccccaaaaatccgtttaatgacgcggcagtcaaaaaagagaagaaacaaaagaaaaccctgagtaaggctcagataaccgggatttacctgcggatgcagcagtatgaagaggaagaacgtttacagaccgccccgcggggcggacgctgtgccttatacccgacggggtactggctgaccgtactggataccttccggctgacgggcatgcgcctgaaccagctgctgcatctgcggttacgggatattaatctggacaacagttacattgagttgcgtgtggaaggcagtaaaaaccacagtgagtggcgggtgccgatgatcccgcagctgaaaccccggctggcgcagttggttgaacaggcaaaagcctgtggcgcgaaagaggatgatccgctgtttgatttaacccgcctgcgtttttgtcatcacggacgccatgtcagtcaccagtatcatcatgacagagaaaagcaacatctccgttctttctttaaccgcctgtctaaagaatgtggttttgctgtctccccccaccgcttccgtcatacgctggcgacagagctgatgaaagcccccgaccgcaatttgcagctggtcaggtgtttgctgggacaccgcagtgtggcgaccacgatggagtatattgatatcgatatggaaatcgcgggtaaaactctggcgaatgaactggcgttttatctggatcttgctgtgtaatccgttaacgtgatgtaaaaaaacagggcaagatatcagcgggattgccctgactgtgtcactgaattatgggatggtttggaggtggagacacaaaacgaagaaaccgggaagtgtgctcaaagagcaattctgacaatcacctgacttgacatcagaatcaattactgaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16901 - DNA, 625 bp, Xenorhabdus bovienii
  unsure (1)..(625): unsure at all n locations
ggttcttggaggagggcccgccaagggaggnaggnnagttntggngcgccattttgctgcctgcagtccaagcaaaaggtgagcacaaactgtgttcacctgacttcgtatagagtggctgtttttagtttattaacttacgcaaagtaatagattatattcattaacatttgcttaacagcacttatttctgactcacgtgttaagttattgatatcacttcaacaaacgagttttaaaattggtgcccggactcggaatcgaaccaaggacacggggattttcaatcccctgctctaccgactgagctatccgggctaacggggacgaattaaaccgtattcagataaatccgtcaacgactttctgcataattttatctgtgtgctttcaacttgttcaagtagttataaatttaaacaataatggagaggatagtgcctctccattcattgatatcgatgatcagctatcgacgatagactttctgggtattattcactttcatcaaataacggcgcgattcagaagctggatgtttattggtcagtgtttcataaacatcaccaggtgccatggtattgatgatttgtgccgcttttttcttatcactggagaacactct

SEQ ID NO: 16902 - DNA, 6206 bp, Xenorhabdus bovienii
  unsure (1)..(6206): unsure at all n locations
nnnnnnnnnnnnnnnnnnnnnnnnagttaggaataacgctgtgcagctgggtaatatgaacccagctatgtctctgaacatgctttagagaatggaaaatgctgaagtgatcaataaaaatgggtcactcctttagcgtttttccaaaataatcgttctgactcattcggcgttaacccattgttatactaatggggacgaagctagctgtaataaccggttatataacgggttgtttagcgaattttggtcatgacaaacaattgtttggcaaacaaggtgcgtctatgtatgcacgataaagtcattggtacattcattgaacaaaactactatattcaatatcaatcaacggattgaatgcgtgacccaaatttgtatgagtcaatgtttgaccgttattgatgcaatcgtttaatatcttttttgttatctcagtgatccctcgcctgcaaggatcacccatcggtcggcgaaataaaaactctcgtagcctgaaagggagtgtaagcattgcggtacatctgcacacttttggaagcagatatcttcggacacctaaccctccgtctgatgatgaaagtttcccggtgttattcaccacaccggctattcacccagcagggcagaacaggctctgtcttacactgaacgataccgttttcatcggtacacccttcactgacattttcaatgcatcacgataaacgtcccgaaaactgcgcggcgtcacttgtgttaaagcacagcgattaccaagtgacgccgccgggcggccaacgtccagagcacgtccgtcctgacttcacaacggatttgatccacattttactcaataaaacctctctcaaacacactatttaccgtccccgccggatccgggctcaaccaccgccccgcccggtacccgtagtagtacagtcctgtcgcatctcgctccttacccgagtaacgaacagtcttataacccgcttccgtctggttcctcgccgtccacactgctgtgcctccgtacgggtagtattcttccatactgataatttgtctgtctccgtccacctccagaccactgctgcccaccagattatcgtagctatagcgcatctgattgttactgatgtcgtccggttttccgctttcccaatgcagtacctggtttatgggcgaagcggtattaccggagcaggtcactcaccgggatgtgctgcggtggcggtatcattcgttggtggagaagaaacaatccggtcatacttggaacaataaggtggctcacctgcggacgatttttaatttcggcatggcaaggacactcctgccacagactgaaaacccgtttaacgatgccgcagtgaaaaaagagaagaaaaagaagaaaattctgagtaaatcccagatcattcatctctatctgctgatgagacaatacgaggaagaggaaagaagataagtcgctccacggggaggccgttgtatattgtacctgacagggtattggttgaccgtgttagacaccttccggttaacgggtatgcgccagaaccagttattgcacctgcggttgcaggatatcagtttggaaggcaattatattgtcctgcgtgttgaaggcagcaaaaaccacagtgaatggcgggtgccgatgatccggcagcttaaaccccggctggcgcagttggccgggcaagcaagagcctgtggtgaaaaagacgatgatccgctgtttgatttaacccgcctgcgttttcgtcatcacggacgaacaatcagttatcagtataattacgataaagaaatgcagcatatccgttctttcttcaaccggttgtctaaagagtgcggntttccgtctcctctcaccgttttcgtcatacactggcaacggaactgatgnaagcaccagaccgtaatctgcaactggtcagaagtctgctgggacaccgcagtctgggcaccacgatggaatacattgatatcgatatggaaatcgcgggtaaaacgctggagaatgaactggcgatatactctggatactttcggtgtaaggataacatcaggtaaaaaaacagggcagatcttcgacaggattgaggaggaggtgtaagtgaacgtccctgcatcaacattgatggtatgaaaaaatggctaattccgatcctgcatcccgtgaagtcttcacctgacttgacatcagaatcaattactgaaatcattaccctgaacgaaaaaagagtgcttgcaaatgcaggcactctgtattctttatttacggcttttttaaaaattgagtatgcagactaagctaccaattgtttaacattttattaacagccctaaattttaacttatttattaatcatttgataatattcaataaattagctttaaaatcttggtgcccggactcggaatcgaaccaaggacacggggattttcaatcccctgctctaccgactgagctatccgggctaacggggacgaattaaaccgtattcagataaatccgtcaacgactttctgcataattttatctgtgtgctttcaacttgttcaagtagttataaatttaaacaataatggagaggatagtgcctctccattcattgatatcgatgatcagctatcgacgatagactttctgggtattattcactttcatcaaataacggcgcgattcagaagctggatgtttattggtcagtgtttcataaacatcaccaggtgccatggtattgatgatttgtgccgcttttttcttatcactggagaacactctcaatacactgccagcaccgccattgtaggcggtaataacggcatatcgacgtgaggttgcgttgttgatttcccctaaatagatattctgcaagatcgatagatatgcggtacctgcatcaatgttattttcaggatcgaagagataactgcgactaggctggccggattttccttgcattttgaagacatctcgcccagcggtatgctgcatgacctgcattaatcccagtgcatcagaacgactgacagcgtaagggttaaagctggattcattttgcataatggcaaggatcagggattcatcaacgccatatttgatggcggctttgcgaaccatcggcaggtatttatgtgcccgtttatctaaatgattaggaaccaattgaatggtgacggtccaaatcatatgtagccctgattggcgtttttgtaatttattctggagaaggtaatttgcaaaatgacgtgcacgccactcccaacgaattgtctcacccgcattatccaaaacttgcccataaagaaatggctctttgctgatctgaatgtcattgatgtcagaataaagatcaacagagccaggatcgtcacccatcagcaaggtggtaataatcgccttgcgtaaatgttcagagggttcaataggcgatagggtttcaattgtgatggttcccgcatcaaaattgatatggctgcgagtttggtattgatccgtgtattttacgtaatctttagggcctgcgattaaaacttcttgtaagccccagatattttcaatgttatgggcaaattgccccattaagatatcaaaaccatttgtatcttttacgtatgcttcattgtattcaatatcttttttgctagagcaggaaatcaggagtggagtgagaagaatcagagccagcagtcttttcattttacaatgccgttaggtattgggatgtcatcagtgttagagcccgataaagaggctcttattttatgttaatgcataataatattatgcatctacctcagtaattgggtgatttttatttgttgtgtcacccaatgacaggcgttataagattatttttccggcggtgtataaccgtcgattttaatatcatgcccttcaaacaagaacttcaccatttcttgttcgagtagtttgcgatgttctgggtttatagtgttcaattttttttcattgatcagcatggtttgtttactcatccattgctgccacgcctctttagaaatctcattgaaaatgcgcttgcccagttctcctggatagagctgaaaatcttggccttcggcttctcgttgcaaaaaagtacaaaaaatggttctgctcataataaatcctcaaaataatagggcaaagtttatcccagctgttgcaaaagatattcaacgggagctgccaatccaatagttgctggctggcgtaagttataccaaagtcccttgctttcatccatgcaggaatcaaaagataaaatatcgattttaatcggtacgatatcgagatgaaagtggctgaatgtatggcgaaatgcaatcagttgatcaggtttgctgtgagagataccggagtctttcaaccactgttccagtgaagcctgatctgtgaattgagggaatgcgaataacccgccccaaatgcctgaaagtggacgttgctccaaccaaaccgtgtcgccatgctgcatcaataaaaaataggccgttttctcagggatggtttgtttcggttttttccctggatagcttgcccaactatgattggcgtaggcgatgcagcctgtattgagtgggcagatttcacatttgggtttgctgcgggtgcagaccatcgcgcccaaatccatcattgcctgattaaaatactcgacaccctgttctggggtaacatgggtactgatatcccataactggttttctacttcttttttccccggccagccagcaatagcgtagcagcgagccagaacgcgctttacgttgccatcgagaatcgggaagtgctttccctgagacagtgaaagaatggcacctgcggtagagcggccaacaccgggcagggcaataacaccatcaaatgtcgtcgggaattgaccactgtgtatcgcaacaatctgctgggcagctttgtgcaggttacgggcgcgtgcgtaataacccagacccgtccataagtgcagaacctcatccaatggtgcggcggccagtgaggcaacatcggggaaacgtgaaataaaattctggaaatagggaatgacagtcgcgacctgcgtttgttgcagcatcacctctgaaagccagacgtgataggacgttttttccaactgccacggcagggtcttacgaccatagcggtgataccattcaagtaccgcctgtgaaaattgctcggcttccatcattagaataattgtctttatagatgatcattgtttcgtgaacaggattgcaacatagtgtaacctcagtgtaaacccgaactttgtttcgaagcgctacgcaaatcagcattaaagttgtgcttatggacactgaacttgataaaatcagccacctttgcataattgcgctctctttaggcaaccctgtggtacataacgtcccagacgcctgagcaaatgcctttaaaactgataaaaagtaccatgataaataacgtaatttcaccggaatatgatgaaaatggcagggctttgcgccgtgtccgcagttttgtgcgtcggcagggccggttaacgagtcgtcagcagcaagcacttgatgatgtgtggccaaagatgggcatggattatcagccggaactgttcgatatgagcgaactctttggtcgtgaagcgcctgtcgtactggagattggcttcggaatgggagcatctctggtgatgatggcaggccagaatccagagaaaaatttttttgggatcgaagttcatgtgccgggagtaggtgcatgtctggcttccgcagaagatgaaaatctcagtaatctgcgtgtaatgtgtcatgatgccattgaagttttggaaaatatgctgccggaacagagtctggaaatggtgcaacttttcttccctgatccgtggcataaagcccgtcataacaaacgtcggattgtacagcctgagtttgcccaacttatcagaagtaagctgaaaatcggtggtgtcttccatatggcaaccgactggcagccgtatgctgaacatatgctgaaagtgatgagcgtggctgaagggtattgcaacgtgtcggaaaatagtgattatgtaccacgtcctgattcacgtccggtcacgaaatttgagatgcgcggtcagcgtttggggcatggcgtatgggatctaatgtttaagagggtaaaatannnnnnnnnnnnnnnnnnnnnnnnnnnnnnnnnnnnnnnnnnnnnnnnnnnnnnn

SEQ ID NO: 16903 - DNA, 897 bp, Xenorhabdus bovienii
  unsure (1)..(897): unsure at all n locations
acgtccccagacgcttaagcaaagcctttaaactggataaaaagtaccatgataaataacgtantttcaccgnaatatatgaaaatgncagggctntgcgccgtgtccgcagttttgtgcgtcgncaggcccggttaacgagtcgtcagcagcaagcacttgatgatgtgtggccaaagatgggcatggattatcagccggaactgttcgatatgagcgaactctttggtcgtgaagcgcctgtcgtactggagattggcttcggaatgggagcatctctggtgatgatggcaggccagaatccagagaaaaatttttttgggatcgaagttcatgtgccgggagtaggtgcatgtctggcttccgcagaagatgaaaatctcagtaatctgcgtgtaatgtgtcatgatgccattgaagttttggaaaatatgctgccggaacagagtctggaaatggtgcaacttttcttccctgatccgtggcataaagcccgtcataacaaacgtcggattgtacagcctgagtttgcccaacttatcagaagtaagctgaaaatcggtggtgtcttccatatggcaaccgactggcagccgtatgctgaacatatgctgaaagtgatgagcgtggctgaagggtattgcaacgtgtcggaaaatagtgattatgtaccacgtcctgattcacgtccggtcacgaaatttgagatgcgcggtcagcgtttggggcatggcgtatgggatctaatgtttaagagggtaaaataatggctaaaaaccgtagtcgtcgtctgcgtaaaaaattgcatattgatgaatttcaggaacttggtttttccgtaaagtggaatttccnnnnnnnnnnnnnnnnnnnnnnnnnnnnnnnnnnnnnnnnnnn

SEQ ID NO: 16904 - DNA, 59534 bp, Xenorhabdus bovienii
  unsure (1)..(59534): unsure at all n locations
nnnnnnnnnnnnnnnnnnnnnnnnnattgatgaatttcaggaacttggtttttccgtaaagtggaatttcccggccaatacaccagttgatatcgttgacagcacagttgatgcctttattgaagaactggttgaaccaaacggtctggcgctggatgccagcggctatttacagtgggaaggtttgatctgcctacagaaaatcggtaaatgtaccgaagaacaccgccagttggtggagaaatggctgaaagatcgcggtatggaagacgttgccctatcagaattgtttgatgtgtggtgggattgattcgctattgcataaaaatagtgttttatacagaaataacgctgtatacaggggctcctttggggcccttgtttgtctggagaaaaagtggtgaaggtaaggttctctaattcgttattggcagatatcttagatgaagtacgccctttgattggccaaggaaaagtggcaggttacatacctgctttggcagaagttgcggtaaataatctggcgatggccatctgtacggttgatgggcaggtttttaaagcgggagatgcggaaaagcgcttttccatacaatccatttccaaggtattgagcctgacactggcgatgacgcgctatcaagagcaggatatctggcagcgagtggggacggaaccttcgggacagccgtttaattcattagtacagttggaactggaaaaaggtattccccgtaatcccttcattaatgcaggtgccttggttatctgtgacatgttgcaatcacggttaagtgcgcctaagcatagaatgctggagttcgttcgtagcctcactgggcaaaagcacatttgctatgatgatatcgttgcccgttcagaaatggatcattccagccgcaatgctgcaattgcttatttgatgaaatcgttcggtaattttgagaatgatgtgctcacggttctacaaacttatttccactattgtgccttgaaaatgaattgtgttgaactggcccaatgttttatctacttagcgaatcaaggccgtatgatcggttctggacaacaaattttaagtcttcggcaaaccagacagattaatgcgctgatgctaacgtgtggtatgtatgatggctctggagagtttgctttcaggatcggaatgcccgggaaatccggtgttggcggaggaatagtctgtgttgtgccaggggagttcacggttgctgtatggtctcctgaactgaatagctccggtaactcactggcgggttgtgcggcattggaaaaattggctgagcgtatcgggcgttctattttttagttcaaaccttagtaaataacagccgaaacccttgtctctgtaggccgggtgtcgtcaggcaaagcaaatcaggagaacgtatgttacgcagaatcgcgattgctgcatcgttattatttgtcgctcaggtacaggcaggttctgactgtcagacgacaattcaggatgacattattgtcacgtcaaagtcggttcagattgttggagccagtggaaacctgagaattttgccagatggttctatgctccgtaacggtaaagcactgtcattgaattcagaacagcgtggtaaggctcagcaatatcagcaggctattcggcaggatctaccgtgggttaagacagaagcactgagccatctgacaagtgcccgtcaagcgctggataaagttgtcgtaaatacaatggggaaggagagtaatatccgtaaccgtttatcccaattggaatctggcctcaataagcaaattgataaagtacttgaaactcgttctgatggcgttgcattcaactctcaggccattaagaaggtggaatccgaagggcagaatcttattcagcagagccttggcggtattttgcaggatagcattaacgaaatgagccgtaagaagagtgagcagaatggtgatggcaaacagatgttgatgtctcttctcggtggattgggcgggatgcaaaatggttttgatgcagaatggaaaaagcaggaacaagagctgaaccgctttaaaggcgaagtttgcagtaaagctaaccaattggaacaactacgcaccaatctcatgaattctattaagtaaatcactgcacatcactaaaaataagaatcaatatgaaattgattcttatttgattgacatcgtagtgttgccacctagaatgcgagtcacttattactaacatgcgtaattcaggtgtaacaatgaaaaaaatcctgccagttgttttagcgtcactactttctgtcactagttattctgcattcagtcagccatcagtgttattcacccctaattccgtgatagtacaatctggtgatttcgtcacagtaaaacatctttctggtgaaacacaggttaaaaagaaccctgagcggatcgtcctgtttgattttgggatttatgattcactggtaaaactgggtttatccgatcgcgttatcgcattacctgtcggcaatgcccctgaatatgtgcgtggcaatatgtcagcaaatatgcagaatgcagggggaatgaaagaaccggatttagaaaaattggctggcatgaaaccggatctgattgtgattaccgggcgtcaggggaatttctatccatctctgtcaaaaattgccccaacagtgaatttagatactgacagtaaaaattatttgtcgtctgttgaaagcaatttaaagttattaggtgaactatttaacaagcaggatgcggttaaggcccagattgtagatctggaaaaaacgattgccacagcgcaggaaaaagccaaatcttcagatagtaaggtattagttcttttacataacgccggcaacttatatccgaacaaccaagcaattgtttatgacgtggttaaagcacagcgtgcggaattaccacttcctacagataaagaaaagtcccgtgttgtaacggcagaaatgattgctcaggcaaaccctgatgctatttttatcatcgaccgcagcaaagcgattggtgcaggcgaattgacaaaagatcagtttgaaaatgatcaggtaaaatcaaccaatgcctataaaaatggcaagattgtttatctgcaacctgatctatggtatttgtctggcggtggactggacagtatgactcgacaaattaatgcggttgctgatgtactgtaatttcataaattaattattccttattaaatcagcctcggaaaatgaatactaaattctaatgagttggttggtattgatatcattaccatcaaaaataaacgggacttaaagcaattcttgcaaggcattcgtcaataaaggctgcacctgatatttgcaggtgcagattatatttttaaagaaacagttctaacagtgaattcaggaataacttgccgtgtttggtgatctgccagtgcgtcgcgttttcagtgatataacctttagccagtgcttcatcaagttgtggacgaatggcactttccggtaatccggtaaaatcactgaaatcgtgtcgtggcatagcttccagcaagcgaaaacggttcatgaagaattcaaatggacgatcttcattatccacttgattttgctgatccagataacgtccctgcatatagccagccgggtgcttggttttgactgtacggagaatacggccatcttcaaacgagatttttccatgtgcgccgcagccaatacctaagtaatcaccaaaacgccagtaattgagattatgctgacattgataacccgctttggcataggccgaagtttcatattgctggtagcccgcagctgtcaataattgatgcccttgggagaagatatcccatagcgcatcatcgtccggcagaacgggcggacgggaagcaaaactggtattgggttcaatcgtcaattgataccaagacagatgcggcggggaaagttcaatcgcctgacgtaaatcatctaatgcttcattcagtgtttggttgggcaacccgtgcatcaagtccagattgaaactgcgtaaaccaaggtcggcagccaaatgtgctgcccgttttgcttcgtctgggccatggatgcgccctaggcgaatcaacttatctgaaccaaagctctgtacgccgatggaaattcgattgatgcctgctttctggtaagcgctgaaacggccagcttcaacggttcccggattggcttccattgtaatttctgcctgcgcggagagtggcagtgacgcccgtactccgtcaagcaggcgttgcataccctcagcgctgagcaggctgggggttccgccgccgataaaaattgtcgatacttcacgattttcaatcatcggcaagtcagcacgtaagtctgccagcaggtgatcaacatactcctgatgtggtacatctccctttaacgcatgtgaattgaaatcacagtaagggcacttttgtacacaccagggaatatggatataaagacttagtggaggtaatttaagcattaagcatggcttccaacagcattttcaacgcttgtccacgatgtgaaactgcacttttttgttcgcgactcagctctgctgccgtacagctaaattctggcacataaaaaatcgggtcatagccaaaaccgccattgccagcgggttcatgggtaatgatgccagaccagcgaccgtggaaaatcagtggagtcggatcttctgcatggcgtagatagaccagcacacagttgaattgtgcctggcgctcttcatcaggaatatcacgcatcgcttccagcagcttttccagattattccgatcggaagcatcaatacctgcgtagcgggcagaatagatgcccggtgcatcacctaaggcgttgactgatagccctgaatcatctgctattgcgggtaatcccgttattgccgctgcatggcgagccttgatgatggcattttcaatgaaagtcaggcctgtttcatcggctgaatcaacacccagctcggtttgagccacgatatctaagccaaagtcagtcagtaaatcagccaactcacgaactttgccagcattacctgtggcgagaacaactttttgcatgcttttatccaattaatctatttatctaatcaaccgcttatcattgaaattaaccacgcccatgacatcgtaacgtagggcattcagcgcgtagagaactaatatgacaatcatggcagaaaaatcaatgccacccatggcaggaatgatacgacggataggtgacattaacggttcagtcagttgaatcaaaacatagtcaaccggattgcgcccttgactgatccaacttaataatgcacgggcaatgacgagccagaatatgagttttccggctgcggtaagtagttcaatcagcccgacagggaacagaatcgcgagaggtatcacaaattgtcccgttgcgagccatgcaggtatcagcatcttaagaagaacgatcagataggcaaatactatggatgctgtatcgagaggaccaatggcggggatgaccctgcgtaatgggcgtaccacgggttgggtgattttaacgataaattgcgcgaatggattataaaaatcacaacgtacccattgcatccagactcgaagcagtaaaaccgcaatatataaatctagaattgtaagaaagataaagtttaagaattgcatgtagcagccctgattaaatgacacttgattgaattaaaatagtttttccatttcctgcgctcggcggattgctgcctgcatggcgcgggatacgatctctggtagatggccttcataaaaaatgcgcagagcttcggcagttgtaccgcctttagatgttacctgctcgcgcagaatagcaaaaggaagatctgcctgtgactcagcaagtttagccgaacccgtaaccgcttgcaggacaagttccctggcagtttggctatcgaatcccagacgttcagcttcttgctgcatggattccatgaacaggaaaaaataggccggcgcactgcctgcgacggcaataatattgttgatgccattctcatcattgacccagcagactttaccaacaccgcacatcagcgattcggtaaactggcgatcaggctgagtgacgtgttcaggcgcaaataatccactgagcccctgccctacaagtgcgggcgtatttggcatgatgcggatgatgttgagttgatcctgtaatagcgtgtaaaaacggctaacaggaatgccagcggcaatggagagtactagtttatgactgaaatctatttgtgaacgcagtgaatcacaaacttcttccatcatttgaggttttactgccagaacaatgacatcggcttcttgggcataacgaatgttatcgttttcgctgttgatgccatactcttttgccagaacgtcacgacgggttgtatttggggagcagacagtgatgagtccagcaggataacctgttctgaccagtccggcgataatggcatgagccatatttccagcgccaataaaggtgattttacgattttccattaaatagtctcgcatattaatcagttgattttggccagttaatttagggttgagtattgtactgacgggcaccgaaaattgccgttccaatgcgcaccaatgtagagccgcaggagatagcggcttccatatcatccgtcatacccattgaaagtgtatcaactcgtggatattgcgttttcaattcaataaacgcctgttccatttggtggaatatcgccatctgacgttcaaaatcgctttctggtgccgggatcgccatcagcccacgtaataccagattgggtagcgcattgatggtctttgccagttccggcagtgattccaaaataatgcccgatttgctgtcttctccactgatattaatttgaatcaggatattaagtggcgccatgttttcagggcgttgctcacttaagcgctgggcgatttttaatctgtctatggtatggcaccagtcaaaatgttctgctaccaagcggcttttattggactgcaaggggccgataaagtgccataccaaatcatgatgattggcaaagtgttgaactttctcaaccccttcttgaacgtaattttcaccaaattcccgctgaccagtcgctatggcttttgcgatagcgtccgcaggtttggttttactgactgcaagcaatgtaatttcttgtggagagcgtccgcaattctgtgctgtaagggctatgcggttcctgacatcgtgaagattttgtttgatattgttcataagtgactcaggagattaaaaaatgaatatggaaaaattggtggctcttagtgtaaagcataatgcttctgatctgcatctttgtgtcgggaaagttccggttttgcgtatcaatggtgtgctgtacccacagatgcaactggcagaaatgcagggtgataccctcatggcatggagcagaaaaatattgaccgaagaacaacagcagcagttacaggaatacggtcatgttgattttgtggtggaaatgccagataaacagcggctcagagggaatctgttttaccaacagtgtcaggtttcattggtattgaggttaatcgcggataaatgtcctactctggaacaattatatgcgccggacattatccaacgtctgattttgcaggagaaaagtgggctggtattagtgacaggcgcaacgggaagcggtaagtctactactttgtcggcgataatcaatgcgttcaataatcatggcaacaaacatattatcacgttggaagacccgatagaattcgttcatcaaagccgaaattgcctgatacagcaaagacaaatcggcagggatgtgcaggattatcaaacggctttgaaaggtgcattacggcaagatcctgatgtgattttgctgggagaattgcgtgacaaagagacgatccgtttggcattgacagcggctgaaacaggacatttggttctgtcaacattacatacccgtggggcaattcaagcactagatcgtttggttgatgttttcagcgcagaagaaaagggctggatctgcagccaattggcaggaagtttaaaagcagtcatttctcaacaactgcttctggccagagaggggggaagagtagccatttatgaagttttggtcgttaaccaagcggtcagccatttgatcagggaaggaaaaaatcatcaaatcgcgacattaatgcagacaggtgctgcctgcggtatgcaaactcatgagcaaagccggcaacaacgtgagttgttgggattgctggctgttgttccacaatgacatccctatttcattgtgagtattgttgttcaaaccaactttccagaatgacgacagcagaagcagaatcaactttgcctttatccagtgccttgtaaccaccgtgatcgaacaggtgagagcgtgcttctatggtggtcaatcgctcatcgtgcagttcaacctgaacgccaaaacgcccgtgtagccgattggcaaatttacgcgcctgagcagtgacgagttgttctgtgccatccatattcagtggtaatccgacaatgaccagatcgggttgccactctttgagtagtttttcaattaattcccaactgggagaaccctctttggctttgaaggcgctcaatgctctggctgtaccggttatttcttgtccgatagcggtaccaatgctgtgagtaccgaaatcgaatgcgattattgtgcgatttttcatcaggcatgccctgcttgtggtgcgaggttgtaaatattgatcccgagcagtgaagcggcttcataccagcgatcggcaacgggggtatgaaaaatgatggaagattcagcactgacggtcagccagctattttccatgatctcttgttctaactggcctttttcccagctcgaataccccagggtcattaaaacattttcgggctggcgtggagtgcctaatgcttccagcatgtctttggacgtggttatcatcgtttcatcagagatctggatacttgaactgaacccggattgcggagtgtgcaagataaagccatgttcttcagacagtgggccacctgccatcacgggtttatttaaattgatgctatcgtctctatcttcgggagtgatatccaacttttctaggatgctttggatagaaatttgggctataggtttattgataactaaccccattgccccgttttgatcgtgttcgcagatataaactaccgaacggttgaaataaggatcagagagcgaaggcatggcaataagaaaatggtgctgtaggttcatgtgttttctgataattattttggcaatgttagcgtgatttggctcacagtatgtgagccaacattataaatggtaaatgctgtccagcctgttatgccggctgtttttccaatcgtttttcgatggcatccatcagcataccagtaatagaaatttctgggaatgcagcttctatttcacgtacacaggtcgggctggtgacgttgatttcagtcaaacggtcgccaatgatatcgagcccgacaaagattaaccctttctctttcaagactggcgcaacagcatgggcaattgcccagtcactttctgtcagaggtcgggcttctccgcgcccacctgccgcaaggttaccgcgggtctccccttgtgcaggaatgcgtgcaaggcaatagggtacaggttcgccgtcaacaaccagaacacgtttatccccgtccttaatggccggcaagaaattttgcgccatacaataacggctgccatgctcggtcagcgtttcaataatgacacctgtattcgggtcatcttgttttaaacggaagatggaagcgcctcccataccgtccagtggcttaaagataacatcgccatgtttttgatggaactcacgtaaggtttttgcattgcgagtcaccagtgtatctggtgtcaattctgggaaccaggctgtgaacagtttttcgttgcagtcgcgcagactctgcggcttgttaacgatcaggctgcctttggcttcagctctttccagaatataagtagcgtagatgtattctgtatcaaaaggaggatctttacgcatcagaatcacctgcaaggtatcgagagcaatctcttgctcgctgccgaactgataccattgctgcgggttttcttcgatcgtgagcaggcgggtacgggcccgagcctctccttgatatagatagagatcattcatctccatgtaatggatttcccacccgcgtttctgcgcttccagcaacatggcaaaacttgtgtctttcttgattttgatggatgaaattgggtccatcactatgccgagcttgatcattctttctccttaacccagatcaccgaaacgcacttgcaatgccgtaattgcggtgagtgccgtagtttctgtcctcaagacgcgagggcctaacaggatatcagtaaattggtgatttgccgtcatttcgatctcttcagcggataatcccccttcagggccgattaacaggcgtactttttccactggcagtggcagtgtgttgatactttggctggcacggggatgcagatttaattttaggctgccatcgttttccgcacaccatgcttcgagtgacatgaccgggcggatttctggaatacggttacgcccacattgttcacaggcagagatcacaatttttttccattgctgtaattttttttctagcctttccgcatccagcttcacaccacagcgttcagaaagtaatggagtaatagtattgacacccaactcaaccgatttttgaattgtgaattccatcttttccccacgggacatcacttgccccagatgcaggtttagtggtgattcatgatcggatagtttgccatcagtaatacgtactttgattgtttttttattggcctcaataagttctgcatcgaaaacctgattgctgccatcaaacaactgtaatggctgcccattactcattctaagtacccggccaacatggttggcagcctcatcactcagatagatttccgtctctacggagagccgttcagggtgatagatgcggggaattcgcatatttcttctttccttcttttttccggtatgacgcaatagccatagtacaaagctgactcatcgccatgataaatgagcgctgattgcgtgatcaagctatctcttaaaccacagggaacacggtatgcacttgcgagccgactcgcatatttatttcataatgactgttttaactgattttttattgctaaccaattgagtgataaattaatattcctcgtgttctgatttcggtcagaaaaatagataaggaatataatgacagggatgttattcacgagtgccatgtcgaatattttcatggatgataataaaggatggtttagccaacatggataatatcatgattatgattttctgtagtgcattgatttttttatcaatgattgatattagaatttatcaattgccagatattattactcagcctttattatggattggtcttgtttttaatagcagtgaaaatttagtttcgatcaagagtgcgatatatggcgctatatcagggtatttatttttatggttattaaatagagtctgtcgatataccttaaagaaagagggaataggatatggcgatctgaaattaacagctgctattggtgcgtggctgggtatggaaacgatccctgtattgatgttgttgtcctcaacatctggattgttcgggtttatgatagtttggtttaaaagaaaaacataccctgactttattgcgtttgggccttatatttgtttgtctgcgatagtgttgatggggtttagagtaagtggtatcaatatcatggggatttaatcgagagcaacttgcaggttttgtgtaaaaagttcattctctcactttatttattggagaagagaatttctattatggtattaaagattacggcactactggaaaatcaggtttttgcaccctacaaaacggttttgacgggtaaacccgggctaagtttactgattcaggatcaagatactacaatcctttttgacactgggccagatggtagctttattgataacgcaaagaaattaaatatcgacttatctaaggtttcagcggttgtgatatcacatggtcattttgatcattgcggtgggctgccttttttctctactgatgctaaagttatttgccatcctgaggttaaaaatgaaagatattatggttgggtaatcacggacaacaaagcacttacattcaaaaaattatccaaacaagtggattacggaaaatttgatacttttttttcaaagggtgagacttatattaatgataacttcatctattcaggagaaataaaaaaagaagagaataaacgctatggcgttattgttggagaaaaatctgaaggaaaatattctcctgactttgttaaagatgaaggtgttttaatttataaatctaaacatgggttaattatttttattggatgtgggcattgtggtgttattgaaattatcaaattttgtaagcagataacgggcattgatcaagtttatgcggttattggtgggctacatttacgttatgcttcgccgtttaaactattgcctatcagaaagtacatcaaaaaagaaaatatacagcatgtttatgcttgccactgtagtggtatgtgggggaggttatggttacctaatgctaaaagtctttctactgggcagtcaattgagattgattaatgttattctatttttagataaaaaatgatgctgctatattaaaataacagcatcgtatttaaagtttgttgcatgaataacgttattcatggagcccaaaggaaatatgccaataaatcctgtatggttatattttcaacttactgaggccacttcatttcacctttcaatactttggcactcagctcaaggctggattcatcagcaaggtttggatagtgtttcttcatggctgcaatcaacgcctctgaatctttggcttttggtagctctttttccagtgtggtcagatacttttgcgtaaatgtgactgattccagcgtcatcggtgcactacccacataatggccaggtacaacagtgtcaggtttcaggcttttgatgcgatctaatgtctgcatccagtgctggcgtgatactttggtttgagtatctgcaatccatacatggatattgccagaaacggtgacgccgccaacaacagctttcaatttaggcacccaaacgaaagtacgatctgcggctgggccatccaaaccttccacaatcagtttttcaccgtcaacggtgaaggtatttcctttcagtggctctggcacaataacctttttcggtgcctgatcttgcagaataccaccccaatatgccagtttaccgtctttggtttcattgatggctttgatggtttcaggtgaagcgatcactttggcttcagggaaggcggtcgtgatcacatcaaggccaaagtaaaaatcaggatcagattggctgatatagatcgttgtcagtttttttccggtttgctggatcattttgaccagcgcttgggcgtcactctttttaaattgcgcgtcaatcagaacaacttcatggtcaccactgatgatttcagaagaaacaggaaatataccggtttcacctggattgtagatatccaacttgagattggctgcttgagccagcgatgctattcccagagaaagggtcgccgccagagcgatatttaatgttgttttgcgagccattattgaattcctgtatcaaaatgtttatttgcttgaatggcacgtataataagttgcatatttcgatttaaaaaccgcaaaatctgcaattatttgttgcatatatcgatctaattacggcaggggataaacaggcagaatggataggatcacggcagcacaggtttttgtcacgattgtggagcaggggagcttggttgcggcggcggaacggcttgatatgtcacgggcaatggtgtcgcgctatctggctgaaatggagaaatgggcaggtgttcgtctactgcatcgtacaacacgtaaaatcagtctgacttcggcaggagaaaacgcttatcagcgcagtctaaagttgttggaattagcggagacaatgccagttcagcaatcactggaatcacaaaccctgagagggctgctgagagtgagttgttctcaatcgctgggtactagcgcgttgtctgttgctattcctgaatttatgcgcaggtatccacaaattgccgtcaacttacaaattaacaacagagtcatcaatttggttgaagagcgtattgatttagcgattcgcattactaataatttggaaccgaatctgattgcccgtccattatccatttgtcattctgttgtttgtgcggcgccctcttacttagatggaaaaattattccgcagaaacccactgatttagcctcacataactgcctgacatataatttttttggcaaaagtttgtggctgtttgaaaaacagcatgagcagtattcagttcctgtcagtggtacgcttagtgccaacgaatcaactgtgctgatggaagcgacattacagggagcaggcatcgccatgcagccttattattctgccgctccgtatttaatatccgggcagttggttgagttattgccggattatcaacctcaggcaatggggatctatggtatttatgccagtcgtcagaatatgccggttactttgcgggcattgttggattttctggtggactggtttgctaatgcaccccactggcagcagttaatgttgaaaagctaatgccaattttctcggaaacaggccggtctgttgttttaaatgggtaatgaatatttcgacgggttccgagaatggccgatgtatgggcttgattaaactgaccgtgaatgggatgtctatgctgaatggccggacgcagatccccgcattcttatccagataatccaaggcagtcaggggattcacgacagacataccgataccttcactgatcatggcacagattgaagctgcgctgtgagtttccatgatcatattgcgattgacatgatgttcgctaaatatggtatcgatgagctgtctgtaactatctgttatcgacaggctgataaatttttgctcatgaaaatcttcgggcatcagtcgtgatttttgactgagtggatgactggcagggaggacgcagacttcattcaaggtaatcaacgtttcttgctcagtacctgcgggagcctgcaaatgttcggttaaaccgatatcgtggcgttgtgctgaaagccattcctccagcagtggggattcttgcgggacgatggtcagtttcgcttccggatagcgttgaataaaactatggcaggcttttggcagtaaagattgggaaaacaccggcaggcaggcaatggaaagctgtgcatgttcaaattgacgaatgctttctgctgcattgagtatcctctccagcccataataagaacgctggacttcttcaaataaccgcaatccctgtgccgtgggaaataaacgccctttgatccgatcaaataacctgaatttcagcaactgttcaaaacgcgcgagctcacggctgacagtgggttgcgaagttttcaacaataccgcggcgtcagtcaggtttttggtggtcattactgcatgaaaaatctcaatgtgtcgccatgaacaagagtgcataatttcatctctttaatacggattgctatttcatcatggttaatgcgctatctacataacatgattagtttgaaaaacaatcaaaacgatatcataaataaatagactatagctaaatggatatttttcttcctgccttattgctgtcaataatgaagcatctgctggtcttgtgagaaatttcaatgacgacatcaacttttactggtttttcaggagaaaactttactccagagaatctgcttcgtttgcccgttgattacggaacaccattatgggtctatgacagtgacattattattcgaaaaatcaataaattaaaacgattcgatatcattcggtttgcacagaaagcctgttccaatacccatatcctgcgtttgatgagagcacagggagtaaaagtggatgcggtgtcattaggggaaattgaacgggcactttacgctggatatcagcccggccgtgatcgatccgaaattgtgttcacggcggatttgattgatgaagcaacacttaatcgagtgattgagttggatattccagtcaatgtcggttccattgatatgctggagcagatgggtacacgtcagtcgggtcatcctatctggctgcgcattaatccgggattcggtcatggtcatagtcagaaaaccaatacgggcggtgaaaacagcaaacacgggatctggtttcaggatttaccgctggcgattgagaaagtccgccaatatgggctgaaattggtgggactgcatatgcacattggttctggagtggattatcagcatcttgccaatgtctgtaacgctatggtggaacaagtcatattgtgcggtgaggatattcaggccatttcagcaggaggcggattatcaattccttataaaatgggtgacgaagtagtggatactgaacactattacagtctgtggcatgaagctcgccagcgcattgaacggcacttggggcatcatgttaaactggaaattgaaccaggccgttttctggtggctgaatcaggtattttgatggctgaagtgagggcggtgaaatcaatggggaaccgtcattatgtgctggtggatgcgggtttcagcgatttgatgcgcccaacgatgtatggaagttaccatcatatttctgttttgtcggtggatagcaaacatattgatgaggctaattcgcaggatgctgagttacatgaaacgttagttgcaggaccgttatgtgaatccggtgatgtgtttacccaatcagcaggtggggatgttataccgcgtttgttgcctcacgttcgtgtaggggattatttggttttccacgacacaggcgcttatggtgcatctatgtcttcaaactacaatagccgccctttgatccctgaaatcttgtttattgagggtgacgctcgtttgattcgacgtgggcaaacaatagaagaattgctggcattggaagcggtataaataaaatacggggcattttttgtccccgtattctcgattacttatattgttcggtcaacatcaagcggctttagtctgatgctgactttcaggcttttttgctgaatgaggtacagcaaatgcatccggctcaaactcatcaacattgattgaacgcagccggctattttctgcacgtttcaggatatctgcttcttcttgggtaatcttgtgatccgccaatgcacgttcagctaactgatccagacgtgtgaagcttaggttttttcctgcttcgcggctcaagcgtgcatgaatgggttctgcggcaatgatatcgtgcagagcttcttccaataacccgtgaggattatgctcgcttggtgtcagatactgcccacgaccaatccggctacgtgttgcggaaggggtttgtaatatctgtgccagtttatgatccagtttatcagacggtgcagtatgtgaacggcccaatgggaacaccatcactcgcattaaaccagcaaccaaacggttagggaaattgcgcagtaaatcgttcagggcctgctctgcctgatacaggctatcttctaccgcccattgtaacaatggcagatcttctttctgacggccttcgtcttcatagcgtttcagggctgctgtagccaggaagatttgactcagaatatccccaagacgagctgaaatgcgttcacggcgtttcagactgccacccaatacgcccattgaaacatcagagagcagggcaaggttagcacttagacggttgatgtgctggtagtaacggcgagttgcatcgctgactggcgtacggctggttctgccattagtgatgccaagccacaggctgcgcagggtattgctggcaacatggcccaagtggccaaacagggctttatcaaaggctttgacattgttattttctgctgcggctatttcagccagtacataaggatggcagcggatcgcaccctgaccaaagatgatcatgctacgagtcaggatatttgcgccttctacggtaatagcaatgggtgcgccctgatagacacgggcaaggaagttggatgggccaagacagatgcctttaccgccagcgatatccattgcatcaataatcgagcgctgccctctgtgggtacagtggtatttcacaatagcagacagaaccgcaggtttttcacctagcataatgccgcctgtaatcatcgttgccgcggcatccatcaggtaagtattacctgcaatacgggccagtggctcttcgataccttccattttgccaatcgggagtttgaattggcgacgaatataggagtaagcaccgattgccatagctgcacttttcaatccacctgttgcgttggatggcagggtaataccacggccgaccgatagacattcaaccagcatacgccagccttggcctgccattttcggtccaccaatgatgtaatcgataggaacgaaaatatccttaccgcgggttggcccattctggaatggaacattcagtgggaaatggcggttgccgatttcaacccccggggtactagtggggattaaggcacaggttatacccagtgattcggtattcccgatcaaatgttcaggatcatacaatttgaatgctaatcccaaaacagtcgcgataggagcaagggtgatatagcgcttattccagttcagacgcataccgagcacttgctcgccttgccattcacccatacagacgacgccagtatcgggaatcgctccggcatctgagcctgcttccgggctagtcaaggcaaaacagggaatctcttcgccacgggcaaggccgggaaggtaatgttttttctgctcatctgtaccatagtgctgtaataattcacctggccccagtgagtttggaacaccgacagtaatcgccagaataccagagacaccagacagcttttgcagtacttgtgattgggcataagctgaaaagtccaggccaccatattctttcttgatgatcatggcaaagaagcgattttctttcaggtatgtccagagttctggagagagatcagctaattcatggctaatttggaaatcatttgccatgcggcaggcttcttccacagggccatcaataaatgcctgctcttcagccgttaactgtggcttcggatagttatgcagttttttccaatcaggattaccacggaacagctcaccttcccaccaggttgttcctgcatcaatggcttctttctctgttgtagacatgcttggcatgactttacggaatgcttttaagccgggtgcagaaaatagagatatacgcgttggtgtgaaaataagggggaacagaataatggcaagtggtaatagtagccagtaactccaaagacccgttatgcccatgacgagtgtataggcaacaagtagcaggctgctggcagccaggctgactttgcggtaacaaagcccgccaatcaagactaaaaacaaaataatgctgagagcggtcatagtaaaaactcctgttaatctcaggtgagacatcagaggtctgacctgttgtggtgttcttctttttagatgaggaaaacgtatttatcaatatatttacatcttaattacaatgtagctcacaaagtcattgcagtttgcggtgtgataatttcacggagatgtgatggcatcttctttcgagagagggaatccgttacactgatcggcagattttattaattcctaagaccgttcaggagtatgagtcccatgtatcaagatctgatccgcagtgagttgtctgaagccgcagatacgctggctaaattccttaatgatgatgcaaatattgacgctatccaacaagcagccgttttgctggctgattcattcaaagcagggggaaaagtactttcctgtgggaatggcggttcacattgtgatgccatgcattttgcggaagaactgactggtcgttaccgcgaaaatcgtccgggctatccgggtatcgcgatttccgatccgagtcatttatcctgtgtgagcaatgattttggttacgactatgtattttctcgttatcttgaagcggtagggcagaaaggcgatgtactgctgggtatttcgacttcgggtaactccagcaacattatcaaggcgattgaagcagcccgtgcgaaaggcatgaaagtcattacgctgacaggcaaggatggcggaaagatggcaggaacggcggatgttgaaattcgtgtaccgcatttcggttatgcagatcgcattcaggagatccacatcaaagtgattcatatcttgattcaactgattgagaaagaaatggtaacagcctgattgtagtgtgttagaggtaggtaatgtgcgaattacttggcatgagtgccaatgtgccaacagatatcgttttcagtctgagtgggctcattcagcgtggagggtatactggcccccacaaggatggttgggggatcaccttctatgaagggttgggataccggacattcaaggatcaccaatccagttatcattcacctgttgctcgctttgttcagagctatccgattaagtcagaagttattgtcgctcatatccgtcaggcgaaccgaggcaatgtctctctggtcaatacccatccgtttacccgtgaactatggggaaaatattggacttatgctcacaatgggcaattgcagggataccgtaacctgaaaacaggcaattaccggccggtcggtgagacagacagtgaatgggcattttgctggatactgcaacagttatcgatcaagtatcctaagcggccttccaattggcctgcggtatttcgcttcattgcctcgctggcaggtgagctgaggaaaaaaggggttttcaatatgctgctgtcagatgggcagtttgtcatggcctattgctcgacccaattgcattggatcacccgtagggcaccttttggcatggcgaaattgcttgatcaggatgttgaaattgattttcagcaacatactcatcctgatgatgtggtgtcaatgattgctacccagcctttaactggtaatgaagattggcaacgtattgaaccggggtgctatgagttatttcaccttggtgaacgcatagtttgagttgatttactgaagaatgacgaactttcgggtttcacactaacaatatattgcccgtttattatgctgatagtggtaagtttgccatttttggcaaagtattcataggcgggctgtaattgaacccaaaacgaataattatcgttattacgataacgctgtatattctgttgcgtcatcctgaaaggataaatatttattttgatttcatcctgtccgtaagatattgcactttctgcatatcggtagatttcatccatatagcgatcggtcatggcatagcagccaatggatttacaccctccatgaatcattaagttattaccagaatagcctcggaatttatcaaattcattgggaaagcccagattaatcgctcgataatagcggctattgggctttaactgtttaaggctaacatggtaaaaaccttcgggacttttgaaatcacctgtcagtgtcttagggccaagccctccagagtaattacagatagggtaactttgagccaattggtaatggcctgtgttgtctttcgtataaagttcaagcactttttcttccttgaatatttgaatgaaaatctcggcaccaagttgtttcagccggagtcgttcattgggtgactggagccacgatggagtgctttgcgccagagcagaacagggcatatggaataacagaaatagtgaaagataaaacgccgtttttttcataacagagccgtataaaaggataacaaatttaatgaaatatcggattgaaagttgccatgtattgacaatgagctgaatacaaatatagcagcgatgtttggcatctgtgaaatggtggagcggccaataaatgctctgttatcgggaaagatgaagctttagttcgtctttatcgaatggttaacgatttagcagagaaattattcttatttgcttgagctgaatcactcgattagtcagacagcttgtgaggggagatgttagaattaccgccggcgaaaattaagagaaaattgtaacgattatcggagtgaataacttgagatatatgcagctcaaggcgttttttattactgaagtcgctatattacccaaggaatacctcagggtaatctgtagcatgtgatttaactgataaacttgtgcaaatcttatgattaaaattaaaaaaggactcaacctcccaatagcaggagcgcctgcccaagttatagaagatggtccgacaattcgccatgttgccttattaggcgaagaatatgttggaatgcgtccttctatgctggttaaggaaggtgagcatgtcaaaaaagggcaaattctttttgaagataaaaagaatccaggggttatttttacgagtcccgctagcgggaaaattattaccatcgggcgtggtgaacgccgtgtacttcaatctgttgtgattgaggtgagtggtgatgaacaagtcatgtttgatcgctatgatcgcgcagaacttgctggcctgactcgtgaacaggtggaaacgaacctgctcgtatccgggctgtggacagcattgcgtacacgtcctttcagtcattctcctgttcccggttccacaccaaaggcaatcttcgttactgcaatggatactcagccattggctgccgatccattagtcgttattgcgacgcaggaagaggcttttgttgatggcctgaatattctgtcaacattgacagagggaaaagtccacgtctgtcatggcgctggaaatattccaaatgcaggaaacaacactcaaattacttacaatcaatttgcgggcccacatccggcaggtctggttggaactcacattcatttcattgaaccggtcagcgtgaagaaaagcgtgtggcacttggggtatcaggatgttattgccattggtaagttattcacaaccggtgagctttatactgatcgcgtcgtatctctggcgggcccgcaagttaaatcaccacgcttagtacgtagccgtctgggggctgatttgcaggaattgacgcaagatcagctgaaagaaggtgaaaaccgtattgtttctggttctgtactgtgtggtacaaaatcagatgaagttcgtcattatcttggtcgtttccataccttggtctctgttcttgctgaaggccgtgagaaagaactgtttggctggattgcaccaggagttaataagttctcgattacccgtaccacgattggtcatttcctgaaaaataaacgttttgccttctcaaccagcacgaatggcggggaacgctctatggtgccaatcggcaactatgagcgggtgatgccactggacatcatggcaacgcatttgttgcgcgacttgcttgcaggcgatagcgacagtgcccaggcattgggttgcctggaactggatgaagaagatttggcattgtgtacttatgtttgccctggcaaatatgagtacggtccggtactgcgtgacgtgctgactaagattgagcaggaagggtaattcatgggcctgaaaaatttatttgaaaaagtagagcatcactttgaggccggcggcaaactggaaaaatattatcctctgtatgaggcagtttccaccgtcttttatactccgggaacagtaacgcgaggacgtgcccacgtccgtgatgccatcgatctcaaacgcatgatgattttggtatggctatctgtttttccggcaatgttctggggaatgtataacgtcggtaatcaggcgatacccgccctgactcatttatacagcggagaagcattacagcagattctggcttctgactggcattacgtggttgctcagtatcttggtgcatcactgacgccggatgctggctggggcagtaaaatgttgctgggtgcaacctatttcctgccaatttatgccgttgtgttcgcggttggtggcttctgggaagttctgtttgccatgatccgcaggcatgaaatcaacgaaggtttctttgtcagttccattctgtttgcgctgattgttcctccgacattgccattatggcaggctgctctggggattactttcggtgtagtgattgcgaaagaaatctttggtggtacgggtcgtaacttccttaacccggcgttggctggccgtgccttcctgttcttcgcttaccctgctcagatttcaggaaatatggtttggactgcggctgatggcttttccggtgcgacaccattgtcccagtgggcaaatgagggtagccacggcttaatgaataccattaccggccagccggtcacatggatggatgctttcattggtaacatcccaggatcaattggtgaagtctccactctgatgattttcatcggtggtgccatcattctgtttgcccgcattgcctcatggcgcattgttgccggcgtgatggtcgggatgatagcgatgtctagcctgttcaacgcaattggttccagcactaacccaatgttcgctatggagtggtactggcacatggtgctgggtggctttgctttcggcatgatctttatggcgactgatcctgtatctgctgcattcacggataaagggaagtgggcatacggcattctgattggtgtcatgtgtattcttatcagagtcgtaaacccagcatatccggaagggatgatgttggcgatcctgttcgctaacctgttcgcgccactgttcgattatctggtcgtgcaggccaatatcaagcggagaaaagcccgtggctaatgagaaaccaaaaaataatgacagcgttggtagaacgttcctcgttgtttttgtgctgtgccttatatgttcgattgtggttgcagggtcagccgtaggcttgaaagcgcagcaacaggaacagaagctactggataagcagcgcaatattctggatgtggcgggtttactgaaacccaatatgactacagcggagatgaaagaaacctatagcagccgcattcaacctgaattgcttgatttgaagacggcaacgcttgaaaaaggcgatggtaaatttgacctgaaaaatgccctgcgtagtgatgaaaccagtatgactctgtcatcggaacaggatctggcgagaatccaccgccgcgctgatatggcagaaatctatctggtgaaagatgatcaaggcaaaaccaccgagctggtgctgccagtatatggttctggcctgtggtcaatgatgtatgcatttatttctattgatgtggatggcgtaacctctcgcggcattacttactactctcatggtgaaacaccgggcttaggtggcgaagtggataacccgcaatggcgcaggcaatgggtgggtaaaaaactctacaactcgcaaggtgttccggcgattaaaattgttcgcggtggtgctggcgataacccttacggtgtagatggcttgtctggagcgactctgacctccaacggtgttcagcatatgtttgatttctggctgggtgataacggttttggcccattcctgaaaaaagtacgtgagggagccttgaaagatggctgatagtaaagaggtaaaacgcgtccttcttgggccgctgtttgataataatccaattgcattgcaggttctgggagtgtgttcggcactggctgtcaccaccaagctggaaactgcgctggtgatgacgattgctgtgacattggtgacagcattttctagctttttcatttcattgattcgtaattacattcccggcagtgtgcgaatcattgtacagatggcgatcattgcatcgctggttatcgtggtagaccagattttgcaggcctatgcctacgaaatctccaaacagttatctgtgtttgtgggtctgatcatcaccaattgtattgtgatgggacgcgctgaagcctatgccatgaaatatccacccgttgaaagttttatggatggtatcggcaacggcttgggatacggtgtcattctgttgttggtgggttttttacgtgaactgtttggttcaggaaaactgctcggcatgacggtgctggaatctgtcaagaatgatggctggtatcagccgaacggtctgtttctgctggcaccgagcgcattcttcatcattggtatgctgatttggggtctgcggactctgaaacctgcgcaggttgagaaggagtaacagacaacatggaacattatattagtttgtttgtccgcgccgtctttattgagaatatggcgttagctttctttctcggtatgtgtacgtttctggcggtgtcaaaaaatgtgaagacagcttttggcctgggcgttgctgtaactgttgtgttggggatttctgttcctgccaacaaccttgtctacaatctggtactccgcgatggcgccttgatggatggggttgacctgagcttcctgaacttcatcacctttatcggggtgattgctgcactggtacagattctggaaatgatcctcgatcgttatgtgcctgcactgtataacgcgctggggattttcctgccgttgattaccgtgaactgtgcgattttcggtggtgtttctttcatggcacagcgtgactataacttcagcgaatccgttgtatatggtttcggttcaggtatgggctggatgctggcaattgttctgatggccgcgatccgtgaaaagatgaaatatgcggatgttccagcaggtctgaaaggattggggatcacctttgtcaccaccggattgatggcattgggctttatgtccttctccggcgtgcagctctaaaggcgagaagaattcatggatataatcattctaggcgtagtaatgtttaccctgattgtgttggcgctgacggctatgattttgttcgcaaaatcaaagttggtgaacaccggggatattaaaattgaagtcaatggcgatgaggagaaaagctttacggctcctgctggcgacaaattgttgaacatgctttccagtcagggggttttcgtttcctctgcttgtggcggcggtggctcctgtggtcagtgtcgtgtgaaaattaaggaaggcggtggtgacatcctgccaactgagctttctcacatcaataaacgtgaagcaaaagagggttgtcgtctggcatgtcaggttaacgttaagcaagacctgaaaattgaattgccagaagaaatcttcggcgtcaaaaaatgggaatgtgaagttatctctaacgataacaaggcaacattcattaaagaattgaagctgaaaattcctgacggagaagtagtgccattccgtgcaggtggtttcattcagattgaatgtcctccgcacgtagcccgctatgcggattatgatgtcccagaggaatatcgtgaagattgggataaatttaatctgttccgttatgtttctgaggtaaaagaaccgactgtccgtgcgtattcaatggcgaactacccagaagagcacggcatcatcatgctgaacgtgcgtatcgccacgccgccgccaagaaatccagacgtgacaccgggtattatgtcctcttacatctggtcattgaaagccggtgataaagtgacaatttccggtccatttggtgaattctttgcaaaagataccgaagcggagatggtcttcatcggtgggggcgcaggtatggcaccaatgcgttctcatatctttgatcagctcaatcgtctgaattccaaacgtaagatcagcttctggtatggtgcgcgttccaaacgtgaaatgttctataccgaagatttcgaccagcttgcggcagagaacgaaaactttaactggcatgtggccctgtctgacgccttaccggaagataactgggatggttacaccggctttattcataatgtcctgtttgagaactatctgaaagatcatcctgccccagaagattgtgagttctacatgtgtgggcctccggtcatgaacgctgcggtcattaagatgttgaaagaccttggcgtggaagacgaaaacatcatgctggatgatttcggtggttgatggttgtaacacgttgatttaacgacaagcgcccacactttgtgggcgctgacgattcagaaagagtaagttatgctgagtaaaaaaattatccattggggtgtgctgatgtttgcggttttgctgctgtcagcctgtggtggccccgaacagcaaaatctgagcgggcaaacgatggggacttattactccgtcaaatatgttgctgactcatcgataccttcccctgaaaacctgcaaaaagagattgatcggctgctggaagaagtaaatgaccagatgtccacttatcggccaaattctgaattaagtcgttttaatcaaagccgtgaagtcaacacaccttttctggtatccgccgctacggccaaagtggtcaaggaagccattcggatcaatcaactgacggatggtgctttggatgtgacagtggggccattggtgaatctgtgggggtttgggccggaagggcgaattaccaaggcgccgacggatgaagaactggtcatgcgtcgtgcgtggacgggtatcgataaattgtctgttgaaggcaatagcctgattaaatctatccctgaactttatgtcgatctttcctccatcgccaaaggctatggggttgatgttgtggctgaatatctagcctcccagaacatcaaaaattatatggttgatattggcggagaagtacgcacactgggtaataatggcaaaggcgctccgtggcggattgccatcgaaaaaccatcggatagtggcattgaacagaaggctcaagaaattattgaaccgggtagtatgtctattgcaacatcgggtgattaccgcaattatttcgaacagaatggagtgcgttattctcacaccattaatcccaaaacgagcaggcctatcacccataatctggtttcaattaccgttattgccccgacatccatgagtgcagatggcttttctacggggttggatgtcttggggccagataagggaatggaagtggctgagacgctgaatatccctgtctttatgattgtcaaaacccaagatggctttgaagagcgctatagttcagcctttaagccatacatacaacagaagaaatgaggaggaaaggttatggaagtctttattgcagcctttatctttttcttgttggcttttgcaggaatggcactgggctacatttttaagcgtaaaagtattcagggaagttgtggtggtttggggagtattggtgtggagaaagtttgtgattgcccagaaccctgcgatacccgtaaaaaacgcctggcaagggaagctgctcgtcatgagaagctggaaaaaaaccgaattctttgagggtgtttttgcggtcaaacaattttcagctaaaaaatgcaacccgctgtcagatacacagcgggtttttgttggctgttcagatgatgttgagagagtgacatttgctgtgagcctgctgtaagtaatttttcacggagctcatggaaacatccaaattctttgccacttctttatagcgcataccttgaagttgcgtgagaagaaatgcccgtctggctttttttggcagctcatcaagcgtcttatctattctttccaactgttctagcagtacaagccgaaactctgacgagtttgttgtcgttttcggcatcgtattgacatattctcgataattgtcttcgagctttttccgccgatagtaattggcgagagttctacgagctatcgtaattaaaaaagctctgggatggcggatattttcaagatctgccgactgcatcaatttgatgaaagtatcatgggtgagatcttctgcatggctggggcagacactattctgcctgatccagttgcataaccaatggtggtattcgaaatagaatttctgggctatgtcattgtgtccgcatgtgctttttggtaccgccatgatgatactgcctgaaggggtaggataaatacgataatgattattattttcatttatggattaaaagtcaacgtagtattgtagacataatcctctcaaaaattaagggggttatactcttcatctttcaagttgcagccaacaaagctgcaacttgaaatctattggtggttgattgattgaatatcagttaaaactgctgtgaaatgctgaatttgaaattacggccgatgcctgaagtcgcttcccctaaataagggtagtaatcacgattgaacagattatcgatagtaaccctcgcttcaaagcctttcatataaggtgggcgccagctggcaaacaacccgtgcagggcatatcccttgctggctggcagagaccaagaacccgcttttggatccccatctacaggggaacgatcctgtttgcggataaaatcacctttccagcccatggacatctgccattgtgggatcttaaatcctaacattgcatgtgcagaagtgggtgggatttcagcaacccaggttttgtgccctatccacggatcacgcatagaagcatcacgctgaccgcgcatggtggagaaagaaagttttccgaataacttattgctatcgtagaacgtttctatttccagtccctcaatggtatatcccggcagattacgatgatttgctatcggtttttcacatgaggtgggtgatgcaccgtcagcctgagctttacagtaaacaccacgagttttgaaaatttcatctttgccacggttacggaacagggtagtgcgaatttgcaggctgtcattctcaagcatcaggttatcgaaatcgagaatggcacccaggcgtatgccagtcattttttctacttcaagattgcggctggaacccggaaggctggttttatatgactgaacttcatattgctcatcgactactggtgcccgccaagtacggctgatatcagcaaagagcgaaagatttttgtttgtccgccacataatacccaaatgaggagaccagccagcataagttacaccactataatcatggtttattttaggtgatgtgttgttatacctgggtgctttattttcttcaccaatattctttatatgatcgtaacggacgctcggagttacggttacacttcccagtttcaaagagtcctgcatatatatgctgtaaatttgttgttctccggctggcatatagttaggttggtaataaccgtaattaaattcttggtcattaactgtatttttatcgaacattaagacatcacgatcgttcttatgccagcgagttcctactaataatttgtgttctatactgcctgttgaaaacacgcttttgttgttgatatcgaccatcgtatcgatatatttaacccaacttttttgtcccataagccccgctgaagtaggttttatatctttgttatcaaggcgacgatcgttttgcttggttatggaataggcagacgtgagtgtcagattgagccatggattatcttctggcgcaatattccatttggcggagtagttctggtcgatctgatcacgaaaaactagttttcttttccatgcctcattccaaccatatctttctatatcactggcggatggagcacttatgccatcccgcttggcagcccacggttgccagccatctgactcagaacgcatggctgaaaaactcaatgtatgagtatcattgggataaacattcgttttccataaataggaggtctggttattttgtgagtattcaaaatgtgttccatcaggacgcttaatattgtgaccatcgcgtttactgacatataaaagcccatcgacaaaaccattgggatctctgccgaatatggtgccactattaatccattgtctatcattggtgtgatagctctgtttgatcaaacctccaaaattttcatcgggacgtaataaatcgccggcatctttggtgacaatcttaacggagccaccaaatccaccattgccattcaacaaattgtgcgggcctttatcaacatctatacgcttgattaattcaggctcaataaagatggaaccctggagatatttctcaaatccttttggggcgtcgtccagcgtgattttgatatcttctgactcacccatgccccaaatattcaaagtttgtccaccgggacgtggagaaccagacatagaaaccccaggtagttgatccagcaactgagcaacattatctgcctgagtgcgttcaatatcagttttctttagcacggaactaccggcactgatgctgttgtgtaaactacctacaactgaaagcgatggtaatttaaccacctcattttgcttttcagatttctggtcagatggattttcagcggctaaaacttggctggaaaatgcactacccaacactaatgtacctgagaatgtacttcttaaaatttttcgaatgatggccataattgggcgttttcctaaattttgactattatttgccataaatttcctgaaacataactgaatgaaatattgcattgttataagtcacctaagaaatcaaatcgggtaaataaaaatgagaattatttttataagcatgttttgagaagtgttatggagatgaaatgcactgtgatagatcatgttgtctgacatttttacgggtttactgctggatgattgaaatgattatccgtgtcgttatgctttctcaattgctgactgcgttggcagtgagatcaaagtgcttatgggatgttgtggcaccaaacggtcagaacactcattggcgaggtcatttctgtaagtgcaatttccttaagtacaaggggttagtcaatgaagaaaaagattctcagttctctgatttttgcaggtatcgtagcattgcttgctggttgtgatgatggttcccaaaaagtggaagactctacccaacaagctgaagaaagtactacccagatgaaaaatgacgctgaacagaaaaccactggaatagtggatagtgctaaggaaaaatcacaggaagtgaaagaaggtgccatgcgtgaaggtcatagtctggtagataagtctaaggaagtacaaaatcagataagtcattctgccaatcacctggccgatcaggtgaaatctaaagcggcagatgtgcaaaatgaagtcacgaagtctgtgaatgatacgctggataaggtgaaaaccaaaacggatgatatacagcatcaagccaccgataaggctaaccagcttaaagatgatgtgaaatcaaaggcggaagaaataaaatctgatgtcaataagcaggctgatgattttatcaatagcttcaaaaatgacggcgataaaacagaggaaagttaattctacgattcaatatcctgtcagtaaaaataaattaatactgaagggcgacctgaaaaaggttgcccttatttttcctctgttatcaacttgacttagctatctgctcacccgtaatttaatacccattctgcaaatcacattcaggacataataatggaaatcaaatacagcgtaggaagagaaaatcccgaattaattcagcaggcttttgccattcgcaaacaagtatttactgatgagcaaggatttgacgcagaaattgatatcgatgaatatgatgatattgctctgcatgtactgatatttgatggtgaaaaacccattggagtattacgcgcagttccaatggacaataatatgctcaaagtcgggcgtgtcgcggtattgaaggagtatcgaggtaaaggcattggtcgtaaggtcatggagtttattgaagattatggacgtaaaaatggcgttgtagctatcggtttatcctcgcaatgccatgcccagccattttatgaaagtttaggctatcaagcgcgtggggaaatctatttggaagaaggtgcagaacatatttttatgacattggatttagcataatcattttttcgttgcttcctttttaagaaaaatgtcttggtattgaaaataggtatccatcaatatctggcttgttttaaataccaatacgagaaatatggttgtgcaaacagtattgcatatatccaattttcccgtactggtcgttgattttatattggcgaaaattaattcactgatggcgtattctgtgccgatttgcgagctggtgcgccattggcaacataatattttgcctgactgcgtggtagtggagtacgacaccgaattttatcggcgattttttctgcgatcataatcgttgtggcattcaaattaccggtaataatttccggcatgatcgaagcatcaatcacacgcaagtttttaacaccatgcacacgtccctgaccatccacaacggccacttcatcagtacccatcttacagctacaggatggatgaaaggcggtttcggcacgttcacgaataaaggtatttaattgttcatctgtctggatgtcagtaccagggctgatttctcgaccacagtaaggagccagtgcaggctgtgtcattatttcacgtgtaatgcggatggcatcacggaattcctgccagtcctgcgcggttgacatatagttgaacaaaatgctggggtgttggcgtggatcacgcgaagtgatcttgactcgaccacggcttggagaacgcatcgagccgacatgagcttgaaagccatgttcattgactgcattgctgccgttgtaattgatggcaacaggcaaaaaatgaaactgaatattcggccatgcaaatttttcactggtacggataaatccacctgcttcaaattgattgctcgctccaatacctgtgcctttgaataaccattcagcgccaatctttggctggttgtaccatttcagggctggatagagagaaacaggtttgaggcattcatactgcaaatacatctcaagatgatcctgtagattttgcccaactcccggtaatatctgtaccgccggaatgccaaactcgtttagtacttcttcagggccaatgccagagcgttgcaaaatctgtggggaagcgatcgcgccagcacaaagtaatacttctttacgtgctcttgcctgcgttaaagttgaatcattaccttgataaaaattaacgccgacggccatttttccctcaaattcgagagtatctgtcaaggcgtgagtaatgatagtgaggtttgagcgcgcccgtgcttgatccagataaccacgggcagtgctggcacgtcggccttcaggagtgacggtacgatccattgggccaaaaccttcttgctggtagccattcagatcgtcagtgcgtggatatccggcttggataccggcttctaccatcacatgaaaaagttcattgttgtccggtttgggcgtagtgacgctgactggcccatcaccgccgtgatagtcatttgccccaatgtctcgtgtctccgctttgcggaagtagggtaggcagtcgagataagcccagtcttccaaacctgatagtgttgcccagttgtcaaaatccagcgcattgccgcggatatagcacatgccgttgatcagtgaagaaccaccaagccctttgccacggccgcattccatacgtcggttgttcatatgtggttcagagtcggtttcatacgcccagttataacgggttccctgcaagggatatgccagcgcagctggcatttgggtacggaagtcgaatcggtaatcaggcccgccagcttcgagcagcaggacagtgacatcgcgatcttccgttaaacgggttgcaagcacattacctgctgaaccagctccgataataatgtaatcaaataccattgttatctcctctgtttcagtcatggattaaaatagggattcaaaattacccagttccacctgtattgatttggtttgtgtgtaattttgcagtgtgacgagcccattttcacggccaatcccagaatgtttgtagccaccgacgggcatggcggcttgagattctccccatgtgttgatccagcagatccctgcttccagttgatggatcacgcgatgtgcacgggatagatcttgtgtcactaatcctgctgcgaggccataatcggtgttattggcgcggttgattacttcatcttccgtttcataggtcaggatacacatgacagggccgaaaatttcttcctgcgcaatcagcatatcatctgtgcagtcgctaaataccgttggtgcaacgaatgcgcctttcgccaattcaccttccagcagacgctcaccgccacacagtagtcgtgcatgggtagacttaccactttcgatgtaacgcaatacagattccatatgtggaaagctcaccagagggccaaagttggtatttggatcgaggggagagccaatgcgaatgcgtttaacacgctcaacaattttggcttcaaattggggagccagtcctttcgggacaaaaactcgtgtcccattggtgcagacctgaccggagctgaaaaagtttgccatcatggcgatatcggcagcacgatccagatcggcatcatcaaagatgatcagcggggattttccacccagctccatcgtgacttctttcaagtttgatcctgatgcattcgccatgacttttttgcctgtgacaatgccacccgtaaacgacattttggcgattttcggatgtactgtcagagtgtgacccacttcatgacccgcgccagtcagaacgttaaacaccccatctggcacacctgcttcagtataaatttcggctaatttcagggcggtgagtgacgtgacttcactgggtttgaaaatcatagcattaccggccgccaatgctggcgctgatttccagagggcaatttgaattggatagttccaggccccgataccggcaacgacaccgagtggctcacggcgcgtatagacgaaggaagattcgcgcaatggaatttgctgaccttcgagagaatggatcaagccagcgtaatattccagcacatccgcaccagtgacaatatcaacatattgagtttcagacagtggcttgccggtatccagtgtttctaactcagccagttcatcattgcgttcgcgcaggatattaaccgctttgagtaagatccgtgaacgttctatggcagtcatcgttgcccagattttctgccctttctgagcacttttgacggccagctcaacatcctgctctgttgcagattgtaattgagcgatgacctcaccattagctggattgatcgcatcaaaagtatttttatcgggattaacgctattaacgtaagtgccgtggatataaagcttttgtaagccaaaacgagtcatggattctccttagtcagaactcaggctgtgtaaggtgttccgagtttctgttcgatgtaatcgatggtgatagtaaacgcgctttttatgtcaaaaggcttgctgcttaatgcacttctcagccagatgccgtcaatcagggcagccagcccttgtgctgccagccgagcttctgtttttggtaaaacacgcctgaattcgacacaaatattggaatacaaacgacgttcgttcacctgttgtagtcggtatagattgggttggtgtatgctgcttgcccagaaagctaaccaggttttcattgctgcgttgctgatttgactggcatcaaaattcccttcaacaatggctttcagcctctgggctggggttgcattatcgagcagtcgtaaccgccgtgctacagctactccgagttggtgcaataagtaacgcatggtggattccaataacccattcttatccttgaaataatggctgataataccgttggaaacgcctgcttttcgggctatttgcgcaatactagcatcctgcattccaacctcattgactacggctaatgttgcatcaatgagttgctgttttcttatcgactgcattccaatttttggcatgtttttatgctcagaaaatcaatcattcggcagttattaaacttttttttaattgaatgttcaatcaaaattaaatatgttttattacaatattttcacaatggcaggttaaatttattcgatatagcataatttttgttttttattcaaacggttaattgttttattcttttttgtctttttatttttattaatttcaggaactgcctatgaacataccagacagtccaaaaaacactcagaaggatactctgaactctgtcgtttttttcacctcagcagggctgattatcgtttttactttattcacgatttttttcactgatgcgacaagtatctggataaaaaatacgctgaattgggtgtccaaaacattcggttggtattatttgctggccgcaacgctttacattgtatttgttatttttgttgccgcctctcgttttggttctatcaaattggggccggaacaatctaagccggaattcagtttactcagttgggctgcaatgctgtttgccgcagggataggtattgatttgatgtttttctcggtggctgagccagtcacacaatacatgcggccgccaacgggtgaaggagaaactattgaagcagcccgtcaggcgatggtgtggacactgttccactatggcctgacgggctggtcaatgtacgccttgatggggatcgcgctgggatatttcagctatcgttataacctgccattgaccattcgttctgcactttatcctatctttggcaatcgaataaaaggtcccattggtcatgccgtagatattgcggcagtgataggtacgattttcggtattgcaaccacgctgggcattggggtggtgcaattgaattatggtctgaaagtgctatttggattgcctcaaggtttgggggttcagggcgggctgatactgttgtcggttgtgatggccattgtttctgtcacctctggcgtgaacaaaggtattaggttcctgtccgagctgaatgtgctgttggcactgggcttgatcctgtttattctgtgtgtagggaatactgaatttctacttaatggattagtgcagaatgtgggggattacatcagccgtttcatgggaatgacactcaatagttttgcatttgagcgcccgaccgaatggatgaataactggacgctgtttttctgggcatggtgggttgcctggtcaccgtttgttggattattccttgcgcgtatttcccgtggcagaaccattcgccagtttgtgatgggaacgctgatcattccgtttgtctttacgttgttatggttatcaatttttggtaacagtgtattgtatgaaatcctgcatggtaatcgtcaattggccgaaacggtattggagcacccagagcaaggtttttatggcttgctggcactttatccggccttcacgtttagcgcctctgttgctacgatcacgggattgctgttttatgtcacatcggcagattcagggtcgttggttctggggaatttcacctcaaatctcagcgatatcaataatgatgctcctaactggctacgtgtcttttggtcagtggcgattggtgtattaacactgggtatattaatgacggatggcatttctgctttgcaaaatatgacggtaatcatgggcttgccttttagctttgtgattttttttgtcatggcaggattgtacaaatctttgcgtgtggaggatttccgcaaagccagttcattgcagaatacctcgccaacattggtacatgacaatggttcgttgaactggaagcaacgtctgagccgcatgatgaattttccgggcacgaaaagtacccaacgaatgctggatgtggtttgtcgtcctgccatgcaggaagtggcaaaagagctggaattacgtggtgcgaaagtacagtttaatgcgctgccatcagaaggggacgaacgactgagcccgcttgagttaattgtcgatctgggggatgaacaaaactttgtgtaccaagtctggccgcagcgttattccgtgcctggatttacctatcgtgccagatcgggtaaatcttactattaccgattggaaactttcttgatggaagggactcagggcaatgacttgatggattacaccaaagaacaaattatcagcgatattctcgatcactacgaaaagcatctgaactttattcatctgaatcgcgaagcaccgggtcagacgttgattttcccgaacgggggataatatagatttataacggaagctgcctgcaatatattgagttgttggcagtttttttgttttttaccttgtctgtaattgctaattaagttaacgaattcgagcctaccaatatcaatcatattcaagaatatcaatcatattcaagaatatcaacataagtctccattctatatttaattattcaattgatttattgattaatggtgttgtactttaatcggtaatttatagtcatctcgccttaatgaaggctctgggagctcatccatgtctatttcgaatgctatgcaatccaaaattcctattgctgtgtatctactgggtttaagtttgtttgcgatgggaagttcagagtttttaatcgcaggtgtgctgccaaaaattgctgaggatctgcaagtctcgttaccctctgcggggatgttaatttctgcatttgccgttggtgttctgttcggagcgccctcgttggctgtagcaacattgcgttggcccagacgagcaacattattgttgagtcaggctctgtttgttgccgctaccgccattggaatgctgtcgcccgattattggccgttattgattgcccgagttgtcagtggtatcgcttacgctgggttttgggcagttgctgcgacgacggcagttaatttagtgacccaggatcgcacggcaagggcattggccgtggttgtcagcggattgagtctggcgatggtagtgggtgggccattaggaacggtgattagtgatatagcggggtggcgtgccggtttctgggcggttgccgcagcaacatcagtcatggcgatagcattgtggtttatgttgccggagatacaaccgaatcaggtagaggttccggtattagatactgaattgaaaaccatggcacaaccgaaattatgggtagcttataccactactatgctgacaaccgccgcttatatggcgacattcggctatttgggggcattattgattgatatcagcaagctggcggtggtttgggttcctgcggtgcttgcactgtttggtatcggcgcttttatcggattgactataggtgggcggacagcagacaaatacccattcaagacgctgatgattggcactattggtatcattgtgtcttctattgcgttgacttttttagctgaaaacgtgatagccacaacttgtctggtatttctgctcggagtgtctggtttcgttgttaaccctgccgtcatgaaccgggtctataccattgctgctaatgcgccgacactggcaggtgcaactaatgtatccgctttccagctcgggatcacattagcccccttgctggctggctttgcaatcggggcaggctacggcttatcttctgtggctggagtgggagcattactggcaattattgcacttgtcccaatactgattgacgcgcgtttacatcataaaaattgtcacaacgattaaaaatttcgtcccatcaaggataaatataaacaaaacttcatacagagcgctaacttgtagcaggaattagttcttaaaaaacaagtagcgctcaatgacatgaggctgtatatttatacagttattttggtgtgaaaagaggcatggagaggtgaaatgcgcaaaattattcatattgatatggactgcttttttgctgccattgaaatgcgggataatccatcactccgcgatattcccatggcggttggtggcagcgcagacaggcgtggagtgatcagcacagcaagttattccgctcgccgttttggtgtacacagtgccatgtctacagcaatggcattgaaactctgtcctcaattgaaagtcataccggggcgaatggcatcctacaaagaagtttctcagcatattcgccagattttttcccgttacactgaactgattgaaccgctttcactggatgaagcctatttggatgtgacagactgtcaacattgccacggctcggcgacgttaattgctcagcaaatccgtcaggtgatttttgatgaattgcaactgaccgcttcagcaggtgttgccccagtcagatttctggcaaaaattgcgtctgatatcaataaacctaacgggcaatatgttatttcccctgaacaggttgaggtattcgtcaagtcattgccattacgcaaaattccaggagtgggaaaagtcacatccaagcgtctatctgatatagggttggaaacctgtgctgatgtacaaaactacgacaaggttgcgttgattaaaaaactggggaaatttgggctggcactttgggagcgcagtcatggtattgatgagcggcaaattagtcccgatcgcttacgtaagtctgttggcgtagaaaaaacgttggcacaggatattcatgaatggcgtgattgtgttgaactcatcgaaaaactttacccagaattggaaaaacgtttaggtaaggtaaaacccgatctccgcattgcccgtcagggcatcaagttaaaatttgatgattttcaattgacgacacaggaacatcttcacccattattggataaatcggatctaattcaggtggcaaaacaggcttgggaaatgcgcagagaaggaaggggggtgcggttggttgggctgcatgtgacgttacagaatccacaattggaacggcaattattactggaatggtaatattgggctggtaatactgaaaaggaagctcccctacggctgatgagcaggggaggcacgtattactctttaactgggatcgcttttaagatagcggttaacaactgccagtattgaccaacgctcttgatgtgaactttttcatcaggcgagtgggcgccacgaatggttgggccaatggaaaccatgtccatatccggatacggttttttgaacagaccacattccagacctgcgtggatcaccataatattggggatcttgtcgaataattgctgataggtttcacgaactaaatgcatgactggcgagttggcatctggctgccagcctggatagttgccacttgctgctgtttctgcatctgccagtttggccagagaatttagcatatcaacaacgtaagccttgccactgtcgatcaatgaacggatcaggcagataatctcgactttatcttcttccatagtgacaacgcctacgttcagggaagtttcaaccacgccttcagcaacatcactcatacggatcacaccattaggcatggtatttagcatggatagaaagcgagtctggcaatctgtagtgagtgcctgtgaggaagtttcgatttcatccaataggatgatcaaatttgcttcaacgaccgcatattcgtttttcaacgtattcaggtagtcatctttcaattggtacagtttttcgagctgagttgccggaacggcaatgacggtagaaccttcgcgaggaatagcattgcgcagggttcccccttggaaatcaatcaattttagattcaattcatctgaatgtgcggcgaggaaacgtgccagcaatttgttggcgttgcccaatcccagatgaatatcaccaccagaatggccaccttttaatcccttaatagtcagttgcaaagtttggtaacccgcaggcaatgtttcgcgggaaagtggcagggttgagacaaaattaatgccaccagcgcaacccatgtaaatctcgccttcttcttctgaatcggtattgatcagaacatcagcctgtaaccagcctgattgcagtccgaatgcgccatccatgccggattcttcagtcatagtcagtaaaacttccagtgggccgtgcttgacggattcatctgccagtactgcaagagcagaagccatgccgatgccgttatcagcgcccagtgttgtaccttcagcagttacccagtcaccatcaatataagtacgaataggatcttttgtgaagtcgtgttgtgtatcattgtttttctgaggcaccatatcaaggtgagcctgaagcacgactgactggcgattttccataccttttgtggctggttttctgatcagaatattaccgacttcatcccgttctacatgaaaatttttgctcttggcccatttaatgatatgggacgcgagtgcttcctcgtgataggacggatgtgggatggaacaaatctgggcaaaaatatcccataatggttgaggggataatgttgataactcggacacggcgaatctcctgtaactgcatcttgatgagatggaaatagtaatgtctgacgcattgggagcttttgtcatcttgagctgtcccaatgcccatgccatgcccgaggatatcattttcttgtttgagatgtgcagtcaggatcaggatttcccttgttttttactggtttttgccgatccaaatcactataatcccgcgcaacctttttttccgcaaaaaactcttttctgagatattcttagtttccaggatcaaatcatatgagcgaaaaatatgttgtaacgtgggatatgttgcaaatgcatgcccgtaaattagcacaacgtttacttcctgtagaacaatggaaaggcattattgccgttagtcgtggtgggcttgtaccgggtgcattgctggcacgtgaactgggaatccgtcatgtcgataccgtttgtatttccagctatgatcacaacaatcagcgtgaattaacggtagtgaaaaaagcggaaggcgatggagaaggtttcatcgttgtcgatgatttggttgataccggaggtacagcgcaggcaatccgtaacatgtatcctaaagcgcatttcgtgactattttcgctaaacctgctggccgtcctttagtggatgattatgtgattgatatcccgcaagatacatggatcgaacagccatgggatatgggtgtggtattcgttccgcctatttgtaataaaccgtaatctttttcttttgttatgactaaacaaaacctttcagaatcgttgttcaagcctcggcttaaacagcaggaaacgtctacactggtaaaatatatccgtccacagtccacagcggccagtgataggatacttagtggagagcgccgcgagcactggtatcggatgattgattggcttgcttggatctggaggggaatcaatccactggaaattcaggatgttctcagcaggattgcagcgatagatgccgaacgcagtgatgaccatttattggatactgtgatcggctatcgtaagggaaactgggcatttgaatggacgcagcaggctatgtactggcaacaggaggcgctgcgtgcggagcagacatctgaagccggaacatcttggctaaaggctgcgatgttatatagcattgcggcttatcctcatttacgcggtgatgaactggctgaacaggctgctgcgttggccagtaaagcctatgaaaatgcggctcactgttctgactatgaattgaaaaagctggaatttcagttagaagagggcaaaagtgtcacaggcttattgcatcttcctcctaacgttcaagagccatgtccaacaatattggtctgtaccagccttgacaatgtacagagtgacttctggcgactgtttcgtgatcatcttgctccactcggttttgccatgttgacagtagatatgcctgctgttggttactctgccaaattcaaattgacgcaggatacgtgcatactccatcagcaggttcttcagcagttgaatcaaattccgtggattgatcatactcgcgtaggcgttatgggatttcgtttcggcgcaaatattgcagtacgtcttgcttatctggagcctcaacttattaagggtgtggccgttattggcccgatagttcatacattgctgaatgacgagaaacgacagcagaatataccgtcaatgtacattgatgtgcttgctaatcgtttggggctctatcacgtcgatgaagccgccttacgtttagaattgagctgttattcactgaaaaaccaaggattgctggggcgtcgctgttctgtgccaatgctttccgtttattggaaagatgatgttttcagcccaagggaagactcaaaacttattgcaatgtcatcaatggatggttcgttattggcaattccttctacgccagtctatagtggttttaataaggcgttacatgaaacaagtgtatggttgaaagataaagcttcttaaacttaaatttaaggaatgatattttcaaaccgtttgatgcaaccgtgtttctgtatatgaaggagacctttgtatgactttacctgtaaattattctagaaataagttgttgaagagcttttctgcattaggaccgtatatacgtgaattaaaatgccaaaatggctattttttctttgattgcctagctgtttgtgtcagtgcaaaggtggttccggaaaaaagggagttttggggatggtggctggaattggaagaagacgaaaaagggtttgtttataactatcagataggtctatttgataaaaatggtgaatggcagccgatgggtatcaaaaaaattgctgatcttgagcatcttgaatcaactttgcaggcatttcacaaacgtctgactgattcttttaatactttcaaacttacgttgatcccgtccaaaaacaccatcgctcttcagactcaagttatggcatgagtttgttctaagcccgcttttttttaattttgcgttatgtcggttggcataacgctcctctcctgttaaaactgagcattgttttttcaaacttgtttttttcaaacttactgtaatggcagaaatatgatgaatggcagccaaacattggttgtgaaactgggaacgagtgtactgactggtggctctcgtcgtttgaatcgtgctcatattgtggaactggttcggcaatgtgctcaacagcatgaaaaaggccaccgtattatcattgtgacctcgggtgcgattgcagcaggacgggaacatctgggatatccagacttgcctgctacgattgcttcaaagcaattgctggcagctgttgggcaaagtcggttgattcaattgtgggaacagcttttttccatttatggtattcatgttggtcaaatgttgctgacccgtgcggatctggaagatcgtgaacgctttctgaatgcaagggatacgcttcaggcattacttgataaccacattatccccatcattaatgagaacgatgccgttgcaacagcagagatcaaggtcggcgacaacgataacctttctgcgctggctgcgattctgggcagtgcagataaattgttgctcttgactgatatcgaagggctttatactgccgatccgcgtaataaccctgaagcgaagcttatacctgaagtgcatgatatcagtgatgagttaaaaatgatggcaggggatagcgtttcaggtctgggtacaggcggaatggccacaaaacttcaggctgcgggaattgcggggcgtgcggggatcgatgtcatcattgctgcgggtaataaaccggacgttgttgcagatgtcatcgaaggcaaatcagttggcactcgttttcatggtcaggccagcccgatggaaaatcgtaaacgctggatctttggtgcgcctcccgcaggggaaatcatcgttgatcacggagcagaagccgccatccttgaaaaaggtagttccttactgccaaaagggatgaaaaacgtcaaaggtaatttttcccgtggtgaagtgatccgtatccgcagcttgtccggcaaggagctagcccgcggtgtatgtcgttacaatagcgacgctttacgtctgattgcaggccatcattcacagcaaatcagccagatactgggttatgagtatggcgcggttgctgtgcaccgtgatgatatgatcgtaagttagttaattgatagtgagttaaggattccaccatgctagagcagatgggaaaagcagctaaagcagcatcatggcagctggctcaattgagtaccagccagaaaaatcaggctctgagtcacattgctgacttgcttgaaaaagaaacagaagtgattcttgccgctaatcagcaagatatggaacaggctcgtgaacaaaacatgagtgaagcgctacttgatcgattattgctgacacctgaacgattgcgtgccatcgctgatgatgtgcgtcaggtttgtcgcttggctgatccggttgggcaggtgatagatgggcaatcattggataatggtctgcaacttagtcgtcgtcgtgttcctttgggcgttattggcgtgatttatgaagctcgtccaaatgtcacgattgatgtcgcctcactgtgcttgaaaaccggaaatgcggttatcttgcgtggtggcaaggaaactcatcataccaatcaggctatggttaaagttattcagcaggcgttggagcaaagtggtttacctgccactgcggttcaagccatcagtaaacccgatcgtgagttagttgctgaattgctgaaaatggatagctatgttgatatgttgatcccgcgtggtggtgctggtttacataagctttgtcgtgaacaatctactatcccggtgatcaccggggggattggtatctgtcacacattcgtggatgaaagtgtcgatgttgaaaaggcactggatgtgatcactaatgcaaaagttcagcgaccaagtgcttgtaattccttggaaactttgctggtgcatgaaaaaatagcgtctgattttctgccagcattgagtaccagaatgaaagagcagggcgtgacactgcacgcaggagtatctgcgatggccctgttaaaagatggcccggcagaagtcgttgaagtaatagaagaagattactgcgatgaatggttgtcgctggatatgaatgttgagattgtcagtggtatcaatcaggctattagccatatccgcacttatggtactgctcattcagatgctatcctgacagaaagtctgcaacaggctgattattttgttagtcatgtggattcatcggctgtgtacgtgaatgcaagtactcgctttactgatggcggccagtttggcctaggggcagaagttgctgtcagtacccaaaagttacactccagaggcccgatggggctggatgcgttgacgacttataagtggattggttatggcgattatctatcccgtcgttaatgtcgaaattcattgttagatagcgttcattaaacgatgttaagtcacactttatcgtaagtgtggctgtttgcttgatgaaaagtattttttatattggtgtaaatatttagttactacactttgtgtttaagcttaactatataccttcaggaaaacaacgaaatgaaacagactctatttatcgtaggcgcacgaggtgctgggaagacgacaataggtaagttgttggctgaagcactatcgtatacatttattgatactgatgaaagtattcaagcctcctgtggaatgaccattgctgaccttgttgaacaatatggttggacacatttcagggaattagaaagccaaatactaaaaactgtcagtcagaataagtgcgttatttcaacgggaggcggaatgatactgtcgtctgaaaaccgccagtatatgcaacaaaatggcattgtgatttatttacaggctccagcagaagttttaatcaaacgactatcgctcaacccagaaaacacacagcgccccagtctgacaggtaaatcgatcacagaagaaatcgaaagtatcttgactgaaagagagcagttataccgtgaatgtgcaaatttcattgtggatgctaattcttcgacagaaaatatttcatctttaattaatggctatattttaaaccaagaaatagggtaatttgatatatccaaatatctttgtgcttatttttttatatagccgtaaaattttatatctcagactgcttataccaattatagtatcattttacttactcactttaattttatttaattatattgagatatggatatgttcgtaaaatttatacgattagttgttcgtgtgctctttagagtcacggtagaaggtgatgataagcagttcaaccatcccaaatgtattattacacccaatcatatttcttttctagatggtcttctgattgggctttttctgccggtaaagccggtattcgccgtttattcccatcttgcgacccccgcttttctcagattgattaagccttatgcggatgttgtccccttagatccgaacaatcctatggcagtcaggacgttggttaaagaggttgataacgggcgccctatcgttatttttccagaaggacggatcacgataacgggctccttcatgaagatctatgacggtgctgcttttgtcgcggctaaatcaggcgcaaaagtggttccagtccgtattgatggcgcagagcaaagtatttttgggcgcctgaaagagattatgaaattgcattggtttccgaaaatcaccatcaaggttttgcctgcggtcgatttccctatgccggatgcaccaaattcttcaactcgtcgtcgtttggcgggggaacatcttcacgccatcatgatggatgtgaggatgcagacccgtccaaaagagacgttatttagcgcttatcttgctgcacaaaaacgttttggccgcttcaaaccctgtattgaagacgtaacttttaaggaggatagctatcacgcattgctgaaaaaaatattgggtgtcagtcggattttagaacggtttactcaaaaaaatgagcgggttggactcctgttacctaatgctacagtgatggccgctgccatatacggcgcttcgctgaaaggacgggtgcctgctctgctgaactacactgcgggaacgaatggtattaaaaatgccatgaaagcggcaacaatcaaaaccatcgtgacatctcgtcaatttttggaaaaagggcaattaacccacctgccagaacaggtgacggaagccaattgggtatatcttgaagacctgaaagatacgattacgcgggaagataagctttggatactatggcacctgatttttcctgctaaggccattacgccttcccagaagcctgatgatgatgctctgatcctgtttacctcaggctctgaaggtgcgccgaaaggtgttgtgcacagtcatgccagtttattggcgaacgttgagcaaattaaaacgattgctgattttactcctcaggatcgttttatgtcctctttaccgctgttccatgcttttggtctgacagttggtttatttaccccgttgatgacaggtagccgtgtattcctgtatccaagcccattgcactaccgtatcgtgcctgaactggtctatgatcgcaattgtaccgtcttgtttgggacttcaacgttcttgggtaattatgcccgttttgcccatccttatgattttgcccgcttgcgctatgtggttgctggggcagaaaaactgtcagaaaacactaagcgtgtttggctggataaattcggtattcgcattctggaaggctacggtgtgacagagtgtgctcctgttgtggcaattaatgtacccatggcagctaaaatgggaactgtcggacggatcttaccggggatggaagctcgccttcttcctgtacagggcattgagggcggcggtcgtttacaattgcgtgggccgaatgtcatgaaggggtatctgcgtgttgaagcgcctgagcgtctggaaccaccaaccgcagaagatgccgaaggtaatactcatatcggttggtatgatacaggcgatatcgtttctgttgatgacgagggtttttgtacgatcaaagggcgagtaaagcgttttgcaaaattggcaggcgaaatggtttctctcgaagctgtagagcaaattgcagcgcgagtctctcctgacgcattacatgcagctacagctaagagtgatcttagcaaaggtgaagcgctggtactctttacaaccgatgctaatctgaatagaaatacgatgtcgggggttgcccgagaaatgggaatgcctgaactggcggttccacgcgatattcgttatgtgaagcaattaccgttgcttggcagcggaaaaccggattttgtcacattaagaaaaatggcagaacaggagtaagtaaatgaatggcactgtagagacacaaccactgttaaataaaggaatgaaagcagtattactgtctcaatttctcactgcttttgctgacaatgcgctgttctttgccattttagctcaattgaaggctgaagcttaccctggatggagtctgccagccctgcaaattgttttcgtgctgacctatattgtgcttgcccccttcgtggggcaaattgctgatcggttttcgaaaggccgggttatgcttttcgccaatggcatcaaattacttggtgccatcagtatctgcatcgatatgaaccctttcctcggatataccctcgtagggattggcgcagctgcttattctccggctaaatacggaatattgggtgaattaaccgatggtggtcgtttggtcaaagctaatggtgtgatggaagcttcgacaatcgccgctattttaattggttcagtggctggcggtttcctgtctgatatcagtctcgcactggcattaggtctttgtgctttgatgtatagtgcggctgtggtggctaatttctatattccccggcttgctgctgcgcgccagggtaagggatggaatcccaaaaaaatgctggtggattttatggctgtctgttctgtgctttggcgtaatcaggaaacacgattttcgctagtaggaaccagtctgttctggggagctggggtaacgctgcgcttcctattagtagcgtgggttcccgtcgtgttggggattgagggtaatacgacacctacgctgatgaacgcaatggttgccgttggcatcattgtgggagccgggctggctgcacggtttatcaccttgaaaacagttcgtcgttgtatgcccgcaggtattctgattggcattatggtgattgtttttgctgttcagcaatcgatatggtcttcctacttgatcctaactgtccttggtgtatttggcggcctctttgttgttccattgaatgccttattgcaggagcatggaaaacgcgagatgggcgcaggtaacgctgtcgctgtgcagaattttggtgaaaacagcgcgatgctggtgatgttgggtctgtacctaatttccatcatgctgggcgcctcggtcgttgccgtcggtattggttttggtatcttgttctcgctgacaatggggggagtatggatttgggatctgcttcggaaaaattaatttcttatagaattgaaggcttgttatggatgaaaaaatcctgaatcagcttagtattgaacttggaaagaaactccaacggaaaaaattatccttaacctgtgcagaatcctgcacagggggctggattgccaaagtgatcacagatattgcgggaagttcggcctattttaatcgcggtttcgtgacctatggcaatgattctaaaaatgaaatgctgggtgtatcacaggcatcactggtgcagtttggtgcggtgagtgaacaggtcgttaaagaaatggcagtaggggcattaaaggcggccagagcggattttgctgtttctgtcagtggcatcgcaggtccggatggcggcagtgaagaaaaaccgacgggaacggtctactttgggtttacctaccgtaatggtgaggatgtacataccgtgacatatcgccagcattttacgggtgatcgcaatgcagtacggctccaggctgtcattttttctttaaaaacactgctggaagaaatcataaaaaattagcttgatgctgtatgattatacagtataattaattccagcactttggtatcagaaacggtttatcagcagtggggcagccccttcattgcttacgaaggagtaaacatggctaacgatgaaaacaaacaaaaagcactagcagcggcgctgggtcaaattgaaaaacaatttggtaaaggttctatcatgcgtctgggcgaaaaccgctcaatggatgttgaaactatctctactggctcactgtcactggatatagcattaggtgcgggtggtttgccaatgggtcgtattgttgaaatatacgggcctgaatcttcgggtaagacaacattgacactgcaagttattgcttctgcccagcgtgaaggcaaaacctgtgcttttattgatgccgaacatgcccttgatccggtttatgccaaaaagttgggcgtagatattgataacctgctgtgctcccagcctgataccggtgaacaggcactggaaatctgtgatgccttgtcacgctctggggcggttgacgtcatcgttgttgactccgttgctgcattgaccccgaaagcggaaatcgaaggtgagatcggcgattcccatatgggcttagcagctcgtatgatgagtcaggccatgcgtaagttggcaggcaacctgaaaaactcgaatactctgctaatctttatcaaccagatccgtatgaaaattggtgtgatgtttggtaacccagaaaccacaacaggtggtaacgcactgaaattctacgcatctgtccgtttggatattcgccgtactggttccgtaaaaaatggtgatgaagttgttggcagcgaaactcgcgtgaaagtagtcaaaaacaaaattgcggcaccgttcaaacaagctgaattccagatcttgtatggtgaaggtattaacacctttggcgaattggtcgacttgggcgttaagcacaaaatggtcgaaaaagcaggtgcatggtacagctataacggagataaaatcgggcagggtaaagctaatgccacgatttacctgaaagagcacccagaagtctctgctgagctggataaaaaactgcgtgaattgctgttgaataatacaggtggattcagtagtgcagtctctgattatgtagccgattatgaagataacggtgaagaagtgaaaaacgaagagttctaattactcgttcactctgttgtgacaaactgttttctgaagaaccacatcctgtcgggatgtggtttttgtttttataggagtaatcaacatcattgatacagggatactgaaactggcttgacaaacagactttcagaaaatgtccagacgaattacaatgctgaaaagcggatgaatttatatgggattttacttcttatggaagacattctatcttaaccctattttaatttattcgtgagttgaaatggtgatgcgctataccacctcaaccatacatgaatctgttttttcagcttgatttcgggacaattatgagcaaaagcaccgctgagatccgtcaggcgtttcttgacttttttcacactaaagggcaccagatagtaccaagcagttcactggtgccaaataatgatccaaccttgttgttcactaatgcagggatgaaccagtttaaagatgtttttcttgggttggataaaaggccttattctcgagcaacaacggctcagcgctgtgttcgtgctggcggtaagcataacgatttagaaaatgttggttatacagcccgtcatcacactttcttcgaaatgttgggtaatttcagttttggcgattattttaaacaagatgcgattaaatacgcatgggaactgctgacaggcaaagaatggttcaatctgccaaaagaaaaactgtgggttactgtctatgagacagacgatgaagcctatgatatctggcacaaagaagttggcgttcccgcagaaaaaattattcgaatcggtgataacaaaggcgttccttatgcatcagataacttctggcaaatgggagataccggtccttgcggtccttgcacagaaattttctatgatcatggcgagcacatttggggtgggactccaggtagcccagaagaagatggtgacaggtatattgaaatctggaacatcgttttcatgcagtttaaccgccatgcagatggcacaatggagccattaccaaaaccttctgttgataccggaatgggcttggaacgtctcaccgcagtgttacagcacgttaattccaactacgatatcgatttattcagcgatctaattgcttctgtggcagaagtgactggcacaaccgatcttaccaacaaatctctgcgtgttattgcagaccatatccgctcatgcgccttcttgatttgtgatggggttatcccgtcgaatgagaaccgtggttatgtgttacgccgtatcattcgccgtgcaattcgccatggcaacatgctgggcgcaaaagaaaccttcttctataaactggttgctccactgatcaaaattatgggtgcggcaggcgatgagctaaaacaccagcagtcgttggttgaacaggtattgaaaactgaagaagagcaatttgcccgtacgctggaacgaggcctgcaattgctggatgaagagctggcaaaactgtctggggacattcttgatggcgaaactgcttttcgcctctatgatacctatggtttcccggttgacctgacggcggatgtttgccgtgagcgtaatatcaaagtcgatgaagctggttttgatgttgcgatggaaaaccagcgtcgccgggcacgtgaatccagtggttttggcacagattataacgaacagatcaaagttgacgggcgcagtgatttttcaggttacgaacacaactcacagcaagcgacggtgatagcgattttccgtcatggtgaagcggttgaccagattcattcaggtgaagaagcgatcgtgatacttgataagactgcgttctatgctgaatctggtggacaggttggtgatacaggcaagttgtccaatggcaacggggtatttgaggttgcggatacacaaaaatacggtcaggcaattggtcacattggtaaattgataaatggcactttgagtgtaaattgtacagccaatgccgagattaatatagtacgccgagattcgattcgtttgaatcactccgcaacccatttactacatgcggcattgcgtcagattctgggggaacatgtttctcagaagggttctttagtaaatgataaatatctgcgttttgacttctctcattttgaagcaatgaagccagaacagatccgtcaggtagaaaatctggtgaatgaagaaatccgcaaaaattcatcaattgttacagaattgatggaattggaagaagcaaaaaccaaaggtgccatggcactgtttggtgaaaagtatgatgaacaggtacgtgtattgagcatgggaggcttttctactgagctatgtggtggaactcatgctagccgtactggtgatattgggttatttcgtatttccagtgaatcaggtacagctgcagggattcgtcgtatagaagctatcacggggcaaactgcactgaattctgtttatcagcagacggatttactgcaagatattgctcatcttgtgaaaggtgatataagtagcctgaatgagaaagtgaagacgacactggatagaacaaaacagttggaaaaagagttgcaacagttgaagtctcagcaagcagctcaggaaagctcctctttggcgaatcaaactaaagagatccagggagttcgtctactggtgacacaattgggtgatactgaaccaaaaatgctcagaacgatggttgatgatctgaaaaaccaactgggatcagcaattattgtgctttctactgtgactggtgataaagtcaccctaattgttggtataacgaaggatttgactgctagaataaaagcaggcgatttaatctcttttgttgcccagcaagttggaggtaaaggaggaggacgtcctgatctggcacaggctggcgggactgatgcagcagctcttccttccgcattggctagtgtagaagagtgggtaacattgcggttatagttggtattgccgtgacagccacggcaccatgaaagtgttttttatggtgccggatgtttttttgttgtgaaattgttgaaatgttgggcgcatacttatattttagctatcctatagatataggaaatgtgttcaaaactgcttatactttaagtagatatcattgctttacgttttcacggtgtttgatggataatagcggggaaacctagagacccgactcttttaaattttcaaggagcaaagaatgcttattctgactcgtcgagttggtgaaacgctcatgataggcgatgaggtaacagtcacagtactgggagttaaaggcaaccaagttcgcattggtgtgaatgcgcccaaggaagtttctgttcaccgtgaagaaatttatcaacggattcaggcagagaaatctcagcctacaactttttaattcaagaatggcgtccactcttttttaagacttgggcgctactctgcttccccgctactctgcttccccctctttccaaattgaagtgattcacgcttcgttactaccttattttttattctctcacgtctttttattttctatctgttgaaaaagcatcgttcatgaggttatagcggtgaataatcattttcataaattttagcgagatttaagggattgtgctgttgataaaacatccccttagccgttaaactaagcattatgcgtgctaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16905 - DNA, 7513 bp, Xenorhabdus bovienii
  unsure (1)..(7513): unsure at all n locations
nnnnnnnnnnnnnnnnnnnnnnnnnnnnnnnnnnnnnnnnnnnnnnnnaatatgtgcgccatcgcagcgacgaagagcttgaagaaaagcttctgagtaagattcagaagtaaaggttctgaaagttcacgaagtgaaaacttcaaagtcgcaagttttaaagcgaatggtgaggtggccgagaggctgaaggcgctcccctgctaagggagtatgtggttaagagctgcatcgagggttcgaatccctccctcaccgccattttaagaatgcatccatagctcagctggatagagtactcggctacgaaccgagcggtcggaggttcgaatcctcctggatgcaccatcttaatcaccgtgattcttaggtgtcccaattctgggaaatcaggcaatcaacagcgcctgaatagaaatagaaaactgacaacgcatccatagctcagctggatagagtactcggctacgaaccgagcggtcggaggttcgaatcctcctggatgcaccatattcaattccatgatttcattatggtatttagattctggaaataaggcaatcaatagcgcctagccagaaatagaaaactgataacgcatccatagctcagctggatagagtactcggctacgaaccgagcggtcggaggttcgaatcctcctggatgcaccatattagcccctgccttgataaggcgggggctttttcgtttggcacctttcatatattacatttcttttatcatccgaactcatattttattcaatcgtatatcatcaggattatgtaatcagcgacaatctggcttgtttgatataaagtaaacgcttagtaataatctttttaaaactccacgggaggtcaaattgatcccggacgtatcaaaagcattgtcatggctagaggcaaatcctaccgtgttgaacggtatttgtcgcggtattgagcgtgaaacattgcgtgttactccagacggtcatttagctatgacagggcatccagaaccacttggtgcttctttaacgcataaatggattacaactgattttgctgaatctctattagagtttattacccccgttgatagtgacatagaaagaacggtcgcttttcttaaagatttacatcgttacactgcccagaacttgggcaatgaaaaaatgtggcctttgagtatgccatgctttattgacaaagaggaaaacatcactctggcacaatatggcacgtccaatgtggggcggtttaagaccttataccgtgagggattgaaaaaccgttacggtgcattgatgcagaccatttctggcgtacattataacttctcgttgccaataagtttctggcaggcatggttaggcatcaaagatgcagaaagtggcaaagaacaaatttcagatggatattttcgtctgatccgtaattattatcgttttggatgggtgatcccttatttatttggtgcatcacccgcgatttgttcttcgttcttacgtgggcgagagacagcactcccttttgaggaaactgaaaaagggacttgttacctgccttatgcaacctcgttgagaatgagtgatttggggtataccaacaaatcacaaagtgatctgaatattacctttaacaatctccattcgtatgtagaaggtcttaaaaaagccattcataaaccatctacagagtttgcggctttggggaacaaaaaagatggtaaatatctgcagcttaacaccaatgttcttcaaattgagaatgagctgtatgcaccgattcgtcccaaacgtgtcactcaagagagcgaatcgccctctgatgccttgctgcgtggcggtgtagagtatatcgaagttcgttctctggatattaatcctttcacggcgattggcgtcaatgaaattcagatccgctttcttgatctatttttgatatggtgtgctttggctgatgctcctgaaatgagtagcaaggaacttgactgttgtcgtcaaaactggaataaggtcattttagaagggcgtaaaccagggctgaatatcggtattggttatggtattgagcagcagccacttaaaacagttggtcaagaattattcaaagatttagaacgtgtagctgaagtcttggatacctgttctggaacacaatatcaatcagcctgcaaagagttggttggtatgtttgaagatccatcattgacattttcagcccgggtactgggcaatatgaaagctcaagggattgttggttttggattggaattggcaaccaagtatcatcgtgaactgcttgaggagccgtattcaatcctgagtgaagaatgtttttctgttgagcgtcacgcttcgatagaacggcaaaatagcttagagcagcaaaacagcatggattttgaagactatctaaaactacatgctgggtattaaaaaagaaaatggccaccagtggtggccgaaataaaatctattagagaatagggatgataacaattttgcgcgtcttcacatcttatgaccagccgcaaatggaaaagtttcatctgtttgaaaaaattttcgtaaaaagtctgatacctcaggaggtagtaatatgcctttattagatagttttacagttgaccatactcgtatggaggcacctgctgttagagttgccaaaacgatgaaaacacctcatggtgataccatcacagtatttgatttacgtttttgtgttccgaacaaagaagtgatgccagaaaaagggattcatactctggaacatctgtttgcgggctttatgcgtaaccatttgaatggtgatggtgttgaaattatcgatatttctccaatgggatgtcgcactggtttttatatgagcttgattggtgaacccgctgaattgagggtagccgagtcttggaaagcagctatggctgatgtactgaaggttaaagatcagaatcagatcccagaattgaacatttatcaatgtggtacttctgagatgcattctctgcaagaagcgcaggacatcgctcgccatattcttgatgcagatgttcgagttaacctcaatgatgagctggcgctacctgaagagatattagttgaacttcaagtgtagtatggttgaagggtgtgtaattcgttgaaaatatatatctgatgtttacacacgttctttttagccgtaaaactcttgttaaaaacggctagacttaccttatattgacggggttagcttatttttaactaaccccgtatcaattctattttttatttgaaatgatctttattaacctcagcttcgtttaaaaatagcgatatcacaatcccgtaaattcaagctcggttttttaggttggaatgtataagctattaagccagcgacgatttccaataaaaaaccgagctgactacggtgtcttgaatgcgctatctgagaaatatttttgagctgatccacgaccgtttctatcaaaaatcgctttcttaacatcagcttatcccagagagataacgcttttgccttcatgttactacggacatgagtgattaacgttattccttctgcttccagttcatcgcacaaggcctgtgacaaataccctttatcgccatacaaacaccctgttaacccttgtacccgtgctttgacgggatgacgatcatctttatttcctgaggtcagcttaaccgctaaaagttcaccacaatcattgataaccaaatgaagtttaaagccataaaaccagcctgtactcgttttccctcgctgtgcgacgccctcaaatacgcgatgacggggaatacggaggttgtgacaaacagcaattttggttgaatcaatatctctggcgtcaccttgactgcttttagggcagaatggcgacgttctgacgccttaagctgagcctgttgagggcagtatttctgtaccgcctgatttcttttcaattcccggctaattgttgatggatttcgattgagcgacgttgcaataaaacgttgtgtaaaaccggcttcctttaaactggaaatctgatatctttctatttcggtcagttgtgtataggccatagtgcattttcctttagcgagaaagatgcctactatagcaactgaccgcccttctgaaaaattgcacttgtatcatagtaattatggtggttagctaccatcataagaaacaaggtgagcctcagattgcacatttaagcgagactttgttaataagcgaaggccccttgtttcaccttccacgccagcaccaatattgaacggtaaccaagagcaacaactctgtatatacaagtgaaattggcgtgatggcatcaaataagaggagggttattatgcattatgtcggaatagatgtcagcaagaataaactggatatttgcttgttatatgatggagttaaaggtaaacgcaaaacaaaatcccttctgaataatgaacattcagcctgtatgttaatagcgtggttagctaaatatattcctgccctgcaacaagtcaatatcgttatggaagccaccggagtctatcatgaacggttggcttattcccttcatcaggctgggggaaggattgcaatagccaaccctttacgcgtgcgtgattttgctaaaggtatggggatactgactaaaacagacaaagtagatgcctatattttagcctgttacagtgccttaaaacaacccgatgtctggcaacctcctcctatagaaattcgcgaattgaaggctctcctatgccgtcgggatgcgttattagaagatatccagcgtgaacgtaaccgatatgaaaaaagcggctcaacccataccccaaaaagggttattgagtccatagaggcaatgatgcatcacatgaaaaatgagttatccgagcttgaggctcttattgccgagcatataaaccagcaccctaatttaaaaaaagattttgaacttttaacctcaataaagggggttggaactcagattggtcttaacatgctgattatcttacgtacgaatacctttactcgtgcaacgcaagtcgctgcatatcttggtgttattcctattgcaaagcagtcaggtacatcggtgcatggtcgagtgcgcttatctaaaacggggcctactaaaatccgtgctaagttgtttatgtctgcactcacagcagttcgttttaacccccacataaatgatttatataatcgattggttaataaagggaaggcaaaaatgttggctttaggcgctgcgatgcgtaagttagttcatttgtgctacggagtattaaatacgcagcaatcatatgatgaaaactatgctattagaacttgaccatcaagacggtagcttattaggcgaatccaagttttaatagaaattacttatttaaaagcaatcctcattttgaaaagataagtgtgagtatggagttaattgtgaacgcagagatagaaggtgactcttatattatggagtgaggggaagtagggtgtcaatctttcccctcttaatgataatatttacttattcagaaatttttgctgcttgattaataggagtaactctcacctgtttgataacattaccgtgcactgacagaatttcaaaattatatttattaatctgtacctgagcgttcaattcgggaatttcacctaattcttccagaatcatgccattcattgttcttggcccatccgaaggcaatgcccagccgaaggctttgtttaattcgcggatattggctgtaccatcaactagaacagtaccatcactctgtggcagcacttcttctgctaaagtaggggacatagaagtagtaaaatcaccgacgatttcttctaaaatatcttcgacagtcacaagcccctgaatatcgccgtattcgtcaacgattaggcctgctttttgcttattgcgttgaaaattaaccaactgagtgttcagcggggtgctgacaggaataaaataaatcttatctgccgccttgatcagatttcttttcgtaaacgcttttttttccatcatgaggcgataggcttcacgtacacgtaacatgccaatggcatcatcaagagaatcgcggtaaagcacaattctgccatgtggtgaatgagtcaattgtcgtattactgacttccagtcatcattaatatcaatgccgacaatttcattacggggcaccatgatgtcgccaacagtcactttctcaagatctagtattgaaataagcatatcttgattacggcgtgagagattggtgtttgactcattcacaattgtgcgcagttcatctttgctgacagcatcattgcgaatgtcagaggtttttatgcctagacagcgcataagcagtaagctgattttattaaatgcccagacaagaggaaacatgattttttccagtggccgtagtagtaaactacttggaaatgccactttttctgggtaaagcgcagcgatggttttaggcattacttcagcaaaaactagaatcacgaaagtcaatatgccagtggcgatggcaacgcctgcatcttgataaagacgcatccccacaatagtggcaagcgaagaggccagaatattgatgaggttgttaccgataaggataagactgatcagcctgtcaggacgatgcagtagtgattctacccttcgtgcaggatggctaccttgtcttgccagatggcgtaatcgataacggtttattgtcatcatgctagtttctgaggcagaaaagtaggcagaaatgatgaccatgatgacaagaataatgattaatgtgcttgttgatacattctccaaagcaaaattccttcctaatatttatacagactggctacagtgatcccttgaccgttaataaaccataatttcctgtaatagcctgccgccaaaaaaggcgagtgtcaggataaacgcgccaatcagattgaaccaaatgacacgtttgccgcgccatccttcatgatagtgaccccagagtaagataacgtagacaaaccatgcaatgatagataaaacggatttgtgaatattctctttaccgaaaatattatccatgtacatgatgcctgcacataacgtcaatgtgagtaaaatgacaccgacttgggtaatgtgaaacattttgcgttcaatggtcatcagagggggcatgccagaagaaaaagagaattttttctttttaagcagatgatccaaccagccaagttgtagtgcataaagtgcagcgataagtaaggtggcatacccaaggagcgctaacccaatatgaatgaataactcaatactgtcttccagatgggtaatgaatgcccctggcaccatactggccagcattaaatttatcatggcgaaactgtaaacgatgggttgcagaaaccatgcccgaccacggaaagccacgacagtcataatggtgctcatgagtaagctgacaatcgaacctaaatttaacaacgtgagattttggccgctgctgacatgaaaaatcnnnnnnnnnnnnnnnnnnnnn

SEQ ID NO: 16906 - DNA, 201195 bp, Xenorhabdus bovienii
  unsure (1)..(201195): unsure at all n locations
nnnnnnnnnnnnnnnnnnnnnnnnnnnnnnnnnnnnnnnnnnnnnnnnntgtgctgtgaggcatgctggaggtatcagaagtgcgaatgctgacataagtaacgataaagcgggtgaaaaacccgctcgccggaagaccaagggttcctgtccaacgttaatcggggcagggtgagtcgacccctaaggcgaggccgaaaggcgtagtcgatgggaaacgggttaatattcccgtactcggtgttactgcgaaggggggacggagaaggctagaccggccgggcgacggttgtcccggttcaagcgtgtaggtgggaagaattggtaaatccgttcttctgtgaacactgaggcgtgataacgaggcactacggtgctgaagtggttgatgccctgcttccaggaaaagcctctaagcatcaggtaacagtgaatcgtaccccaaaccgacacaggtggtcaggtagagaatactcaggcgcttgagagaactcgggtgaaggaactaggcaaaatggtgccgtaacttcgggagaaggcacgctggcattaggtgaagggacatgcgcccggagccgaagccagtcgcagataccagctggctgcaactgtttaataaaaacacagcactgtgcaaacacgaaagtggacgtatacggtgtgacgcctgcccggtgctggaaggttaattgatggggttagcggcaacgcgaagctcttgatcgaagccccagtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaaccttgaaccttgatgtgtaggataggtgggaggctgtgaagtgtggacgccagtctgcacggagccatccttgaaataccacccttgaatgtttgatgttctaacgcaggcccgtcatccgggtcgcggacagtgtctggtgggtagtttgactggggcggtctcctcccaaagcgtaacggaggagcacgaaggttagctaatcacggtcggacatcgtgaggttagtgcaatggcataagctagcttgactgcgagagtgacagctcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtacggctgttcgccgtttaaagtggtacgcgagctgggtttagaacgtcgtgagacagttcggtccctatctgccgtgggcgttggaagattgaaaggggctgctcctagtacgagaggaccggagtggacgcaccactggtgttcgggttgtcatgccaatggcactgcccggtagctaagtgcggaagagataaccgctgaaagcatctaagcgggaaacttgccttgagatgagtcttcccttgtcccttgaggatactgaaggaacgttcaagacgaggacgtggataggctgggtgtgtaagcgtagcgatacgttgagctaaccagtactaatgaaccgtgaggcttaacctgacaacaccgaaggtgttttggtgagagagagacggagtttcagatgaaagacagcagcttgttcgggattgaaaacagaatttgtctggcggccatagcgcggtggtcccacctgatcccatgccgaactcagcagtgaaacgccgtagcgccgatggtagtgtggggtctccccatgtgagagtagggcactgccagacacctatttagccagtccggctcataagcagaagccgactgaagttccagtcaaatggataaaagaaattcggtggtgcggtagttcagttggttagaataccggcctgtcacgccgggggtcgcgggttcgagtcccgtccgcaccgccacctttttcgaaaacccctgagatttatctcaggggtttttctgttttcttactctggcgacacgatcaaatttaagaacccgaaaaaatttgttggtggatattgagtgtgaacatctttgcttctcttataaaaataactttgcctggagatagccgtctatcaccgcaaaaattcaacagtaccgcttcgcccataataccgactacatcatcgtagttgtaatcgtacagatgagccttagcttaaggccgtagcgcgccgacattgtgctacaaaagcagtaaaagtgaaaccagagatagaaatgtggatcaaacagttaatttggcaagatttaagtcctgaacaaacagtcggttatctcaaaagtgaaaatataatatctttgcatcatgaaacagtttatcgattgatttataaggataaacttaatgggggtgatttatggcaacatattaggattgcgaaaaaaccgtatcgtaaacgctatggaagttatgagcgcagaggaaaaattaaaaacagagtcagtattgataagcgccccaaacttgttgataaaaagcagcgtattggtgattgggaaggcgatactatcgttggtaaagatcataaaagtgcattattgacattagttgaacgaaaatcgttatttactatcataattaaactggaagataaaacagcagaaggggtcgcaaaagcggccacaagacatttatcactgataaaacataaaattaaaacaatgacctttgataacggcctcgaatttgccgaacacgaactgatcagtgaaaatttagagacaaaaatttattttgctcacccgtattccccctgggaaagagggataaatgagaacacgaatggattaatcagagattacttcccaaaaggaactgattttaataaggtatcagagttggagattaaccttgtggcaaaccgattaaataatcgccctcgtaaaacacgagattacaaaacaccgaatgagttatttaaaggaatacccactcatttacttcgttcattacggtgttgcgcttaacatgtgaatccaagttatataaaataaattaatttattttatatatttaattggcaatataagccatattatcatattgttttttttaatagttttaatcgccaataattatatattccataaaaatggaatatattaatttatattcttatatccaatttaatatcaacatgattctaattctgcgttattaaatgttctattaatatattgttatgccgatatattgggtttttgtacgtaatagattgaaatcaataattgacatgtcatattagatgaataggttgttgatatgtgacgggggttaacttggttagaagctatgcaagaaggaggcacgctaagaaaaactctgcccaaaaaaactatgcaatgcggtatgttgcagaccagcccgtagagctagttttacccacctctaaacgattacttgaagacaactcattaccacatgggcaaccgttaccagcccgcaatcatgaactttgcgttgccatctggaatatttacaaacagcagcgtccatcatggcaagaggttttgggttctttgattgagagcagccagcttattttattgcaggaagcgcaaacgacgcctgatttactgaaattcgttacagccagtggtttagttgcagatcaagtcccggcattttccatccctcagcatccatctggcgtaatgaccttagcatcttcttctcccgtctattgttacccattacgtgaaaaagagccgatactgcgactctcaaaatcttcactgattacgatttatccattaccagatgatcgtcaattgatggtgataaacgtgcatgcgatcaattttagccttggtgttgacgtttacagtcggcaattgaataacattggtattcatatcaatttgcatcatggacccgtgatttttgctggggattttaatgcgtggagccgtcggcggttgagagtattggtgcgttttgctcagcgtatgcaattgaaagaagtctattttaatgatgatcacagaacgattgtttttggcaaaccattagattttgttttttatcgtgaattgaaagtgttaaatgcggcagtcttaactacaatggcttctgatcacaatccattaattgtcaatttttctttataaacgatggaggaaatgctggagaaaaaaaagcgccggcagctctaacgtaccgacactttttcaagtcttattggttagtagagcgatgatctgttgataatttcttcttcacacagaaggaataagccagtgtgaggactaacacccaacctatcccaacatatagagcatcccttgtttgctcaaaataaccgagcaatacgatgacaccgaccatgaaaacgatcgtaattgcaggcgcaattggccacattggaacgggaaatttcaatgacttgatgtcttctgcactcatttggcggcgcatggcaacgtgagaaattaaaatcatcagccatacccagacggttgcaaatgttgcaacagacgcgataaggataaaaatatcattagggatcaagaaattcagccatacgccaagtaatagaaccatagtcatgacaagcacggtcatccatggtacaccattacgggtcagtttcttgaatgcttcaggagcttgtctttcctgagccatgccgtacatcattctacctgcaccaaaaatatcgctgttgatggctgaaatagcggcagtaatcacgacgacatttaaaatattcgctgctgaattaattcccagattggaaaaaatctgtacaaatgggcttgcattctgatcaatctgattccatggatagatgcacatcagaatacacagcgtcaggacatagaagatcaaaatacggaatggaacggcattgattgctttaggaattgttttttctgggtttttcgcttcactggcagtgataccgatcacttctatgccaccaaaagcgaacataacaatcgcaaatgaggcaatcactccactgataccatttggcatgaagccgccatgctcccataaattggaaataccggtagcatgttcagttgattgaccaaaaccgtagatcataattatgatgccgccaatgatcatagcaatgatggcggtaactttgacgatagaaagccagaattccatttcaccgaagatttttacatggcacagattcagggcaccgataaaacatacaatacccagcacccaaatccattgatcaacgtgtgggaaccatagcctcatatacatgccgaatgcggtgatatcagccagacaaacaaacagcatttcaagaacataaatccaaccggtcagaaagccggccaatggtcccagataatggctggcatattgtgaaaaagaaccggaaacgggatggtgaacggccatttcgccaagtgctctcatcaccataaatacggcagcaccgccgattaaataggccagcaatacagcagggccagcatgctgaatcgccgctgccgagccataaaacagcccagtgcctattgcagagcctaaagccataaagcgaatatgccgcacgctcaggccctgtttaagctgattttcattatgttgcattcgttattcccatctatctttcatgccaaagagtatttcaggcatacaatgctctgtctggcgtcaaataccagcaaaagcaaccccgtacaataccataaagatggatgttcgcgggatagatatctgtaataatacccggcagtttagtaaaaccagagtttttttatgatttacccaataaatgaaatttttcaaactttgcagggagaaggcgtgtttaccggtgtgccttcggtttttatccgcttacagggatgtccggtagggtgcagttggtgtgataccaaacatacgtgggaaaaagaggctgataaacaacagcctatggaaaacatcctagtgaaatcgcaggatagtgatacatggggagcagccactgcaagacaaattattaacttattcatccgtcagggttatacggcgcgccatatcgtcgttaccgggggtgaaccgtgtctgtatgatctgcgtcctttgaccgaaacattggaaagtgaaggctatcagtgtcagatagaaaccagtggtacacatgcgatccagtgttctgaaaaaacgtgggtcacagtttcaccgaaagtgaaaatgcgtggcggatatcaggtattacctgaagccatgaaccgtgcgaatgaaatcaagcacccagttggaagggagcgcgatattgaagcattggatgaactgctgacgatgctcgatgaaaaggcagatccggttattgccttacagcccatcagtcagaaagaagaagcaacccgcctgtgtattgaaacttgtattgcccgtaactggcgtttttcgatgcagacacacaaatacttaaatatcgcctgatgtttcactcagcaccagaatctggtgctgagtgttctattcgtcacgatagatacaacctgcgctacaagtctcttttaccatgacggcactgagttggggcagagttggttttaacttttcccagatccacttagctaaaacttcgctggttggattttccagcccaggaatttcattgagataattgtgatcgagccgttcccaaatcggcttaaatgcggattttacatcggcaaaatccatgatccatccgctaagaggatcaacctctccggtaatttccagacgtaccatgaatgagtgtccatgcagacgtccacatttatgtccttcaggaacatgtggcaggcgatgcgccgcttcaaattgaaaatctttaaagatggtagtgctcatgatgcttttctctgattccaaaaggccggctattctacctgaactttacaagcataacgtgatttttctggaggaataaagcacaacgcttaacgactttatcgatatatgaaatctgtaaataaagttaggcattttagttatgagatattgcaaacctttctttaaaatctcatcttattctgggataaccttatgattaatccatgtatagatttctatatcatggatattggctatagcaaagggcacgggatcatgaccacaaaaccaccttcaactgtattattaccggtttctcctgaacaattatcacgtctgcaatctgcaatcggtgatttttctccatatcaactggcgtggttatcgggctatttctggggaatggtaaatcaaaagccacaaactgaagttgttacaccagctgcccctatatcggaaactgtcacactgatctctgcctcacaaacaggaaatgcccgtcgtttagccgagcaactcagagactcgttgttggcggaaaagctaaatgtgaacttggttaatgcgggcgattataaattcaagcaaatcgcacaagaacgggtattgattattattgcttcgacacaaggtgaaggtgaacctgccgaagaagcggtggcactgtataaatatttgaattccaaaaaagcgccatcaatgaaagagacggcttatgccgtatttggtctgggggatacctcttatgaaaacttctgtcaggctggtaaagactttgaccatcgcctgaatgaactgggtgcacaacgattactggagcgtattgatgccgatgtggaatatcaagagcaggcagcacagtggcgtcaacaaataacggaagttttaaaacagcgcctgccagcccagacacaagctggcatcactgtcaatcaagtgggttctgtcagtgaaatcattttcagcccttataccaaagacgcaccactgaccgcttcgttattgaccaaccaaagaataacaggacgcggttcagacaaagatgttcgccatattgaaattgatctggggaattccggcctgcattatcagcccggagatgcgctgggtgtctggtttgaaaatgatccggcactggtggatgaattgattgaattgctttggctgacaggatctgagctggttaatgtgcacggaaaatcactgccactgcgtcaggcgctgatcagccatgttgagctgacccagaatacggggttaattgttgagaaatatgcggtattggcgaaagatcaaaaacttctcgctttaattgctgacaaacaggcattacaacagtacgcacaaaaaacgcctattgtggatatggtcagacaagcggccttacatccagaagcccagcaatttatcgacttactgcgttccttgacaccgcgtctctattccatctcctcctcacaggctgaagttgaaaatgaagtacatgttacggttggggtggtccgctatgaaatagaagggcgtgcccgtacgggtggcgcatcgggttatctggcagatcgattgcaggaagacgacaacatccgcatctttatcgaacataacgataacttccgcttacccgctaatcctcagacacctgtcattatgattgggccgggtacgggcgttgcaccgtttcgagcatttctgcaacagcgtgacaatcagggggctgaaggcaaaaactggttgttctttggtaatccacatttcgttgaagattttctctatcaggttgaattccagcgctatgccaaagatggcttgctgacccgcattgacttggcatggtcacgggatcaacaacataaaatctatgtacaggacaaactgcgtgagcaggggaaagaaatctggcgctggattcagaatggtgcacatttgtatgtctgtggtgacgccaaccgtatggccaaagatgtggagcaggcattgctggatatcatttcacaacagggtgacatggatgctgaacaggctgatgaattcttgagtgaactgcgccttgagcgccgttatcagagggatgtttactaatatgaataatgaaaaaaaaggtcttttgaaggttgaaggtaaactcgctgacagtgaacgcatgaaatcagatagcgactatttgcggggaacgatcagcgaagatttaaacaatgggctgacaggcggatttgagggggataactttctcctgatccgtttccacggcatgtatcaacaggatgatcgtgacatcagagcggagcgggcggaacaaaaacttgaaccacgtcacgccatgatgctgcgttgtcgcttgccgggaggcatcatcacccccagtcaatggctgggtattgatcagtttgcgacagaagacaccctatacggcagcatccggttgactaaccgacaaacgttccagtttcatggcattttgaaaaacaacctcaaacccgcgcatcagttgctggcaaaaatggggctggattcattggcaacggctaacgacgtcaaccgtaacgtactttgcacatcaaatccggtgcagtcggctttgcaccagcaggcttatgaatgggcgaaaaaaatatcggaacacttactgccacgcacgagcgcttatgccgaaatctggctggataaagaaaaagtagcgactaccgatgaagagcctattcttgggtcaacttatctgcctagaaaattcaaaacatcagtggttatcccgccacaaaatgatgtcgatctccatgccaatgacctgaattttatcgccattgcagagaatgaccaattgatcggctttaacgtgctggtgggtggcggattagccatgacccacggtgataagaacacttttcctcgtctggcgagtgagtttggctttattccactggaacacacattgtcgattgcggaagccgtggtgacaacacagcgtgattggggcaaccggactgaacgaaaaaatgccaagaccaaatatacccttgaacgagtgggtgtcgaaaccttcaaacaggaagtggaaaaacgggcaggagtgcactttgaggccattcgtccgtatgaatttacggggcgcggcgatcaaattggctggttgaaaggcattgatgatcaatggcacctgactttgtttattgagaatggtcgtctgttggattaccccaacaaaccgataaaaacggggatcgcggaaattgcgaaaatccacaaaggtgatttccgtctgacggccaatcaaaacctgattgtggcgggagtacccgaaagcgaaaaagcacgcattgaagaaatcgcccgcacacacggtctgatagacaatagcgtgacattcctgcgtcaccattccatggcatgcgtttcatttccgacttgcccgctggcaatggcggaagctgaacgttttttgccggcatttgtcgatcatgtcgatgcattaatggaaaaacacggtgtttctgacgaacatatcgttctgcgtgtgacgggctgtccgaatggatgcggcagagcgatgctggcagaaatagggctggtaggtaaagctcaggatcgctataaccttcacctcggtggaaaccgggttggcagccgaattcctcgcatgtacagggagaatatcacttcagcagagatcctggtgatattggatgaattgattggtcgttggtcagcggaacgtaatacccatgaatgctttggggatttcctggttcgtaccgacatcatcaaacctgtcctgaactcagcccttgatttttacgactggcaggaggcgttatgagccagcttcatttagcagaattgctggcattgaaccacgggcagcgcgccgaagcattggctgacatcaatcaacaactggaattgctagatgcccgccagcgcgttagctgggcattggaacacttatctggcgaattcgtgctttcttccagttttggtattcaggctgccgtctgcctgcatttggtgacacgggaatatcaggatattcccgtgatcctcactgataccggttatttgttccccgaaacttaccaatttattgataagctgactgacaaactgaaactgaacttgacagttttccgggcagaacattctcctgcctggcaggaatcgcgttatggcaaattgtgggaacagggaatagaaggcattgagcggtataaccagatcaacaaagttgatccgatgaaccgtgcattgaaattactgcatgcacaaagctggtttgcagggttacgccgccagcaatcggaaagccgcgctaatttacctgtgctggcagttcagcgcgatgttttcaaaatcctgcctattgttgattgggataatcgccgagtgcatcaatatttggcgcagcagggtcttgaataccatccgctgtgggagcagggctacctctcggtaggggatacccatacaactcaaaagtggcagacgggcatgagcgaagagcaaacccgcttttttggcttaaaacgtgagtgtggtttgcacgaaagttaagccaatatgacggatgacagggatttctattgggttgcaccgcttaaaaaaagaggtgtggcctgcccttaccctgaatatttcgcatagttaacgctataacagactaaaaaattcagcttatgcgattcaggaactaataattcctttttgtcatttcataaccggatctcagcctcatatattcattctctaataatcataataataaaaaattatgagaagactctaacactggatggcatgtcaccgtggactatttacccttatttgttgagttaaaatcccgacccgtattgctggtcggaggtggagaggtggcttctcgtaaggcaagcctgttgctgcgtgcgggtgctgcgttaacgatagtcgcccctgaattgcattttgagctgcaacaacgctatcaaaaagcggaatttgcatgggagcagggcgggtttcggacagaatatctcgatggcgtatttttagtgattgccgcgacggatgaccacgatttgaaccagcacatttttactgaggccaatgcccgcgctattttagtcaatgtggtggatgatcaaccgctttgttctgctattttcccctcaattattgatcgttccccgattatggtagcgatttcatccgcaggaaaatccccagtgctgacgaaattgctgcgagaaaaactggaatctctactgccttttcatcttggcatcatggccgagattgcagggcgctggcgtgagcgcgtgaaacagcgcctgacctccatacgccagcggcgccacttttgggaaaaagccttgaatgggcgttttgccacattggtagccaatgggcaattacagcaggcagaagcacaactcgatgaacaattgatcgatgaacaacgggtcaatgaacaactcgcatcagccggcaaacagggtgaattggctttagtaggggctgggccgggcgatccggggttattgaccttaaaaggtttacaagtgattcagcaggctgacgttgtgctttatgaccatctggtcagtgcagagattctggaattggtacgccgcgatgcagatcaaatctgtgttggcaaaagggcagggaatcactcagtggctcaggaagagactaatgcattaatcattaaactgtcgcgtcagggtaaaaaagtggttcgtttgaaagggggcgatccattcattttcggtcgcggtggagaggaattgcaggctgccgctgaagcggggattacctttcaggtagtacccggtattaccgcggcggtgggcgctgctgcttatgccggtattccactgacacacagagagcactcccaaagtgtcacctttattacagggcactgccgtgaaaatggcgatgaactggattggcctgcattggcgcggggcaatcaaacactggcaatttacatgggtatcataaaagccgcccttatcagccagaaattgatttcacatggacgagatgccaataccccagtagctgtgatcggctgcggaactcgtccagaacagcaggtgctgaccggaaccttgtccgagctggaacggttagcacagaaagcaccatcgcctgcattgctggtggtgggagaggtggctcaactccaccaccagatagcatggttcgggcaacagtctgttgatcaaaaacaatctgttgctcaaataagtcgccctgctgttattgatctcgtataaggagcggtcaatggacgaaaaaaaactgacacacttgcagcaactcgaagctgaaagcatccatattattcgcgaagtggctgccgaatttgccaatcccgtcatgctttattctattggtaaagattcctcggtgatgctgcatctcgcgcgcaaggcgttttatcccgggaaactgccctttcccttgctgcacgttgatacgggatggaaattccgtgaaatgtatgacttccgtgatcatacagcggaaaaatacggctttgaattgctggtttatcgtaacccacaaggtgaagcactgggaattaacccctttatccatggcagtgcaaaacacaccgacatcatgaaaacggaagggctgaaacaggctctggataaatatcgatttgatgcggcatttggtggggcaaggcgtgatgaagaaaaatcccgggccaaagagcgcatctactcattccgtgatcgttcccatcgttgggaccccaagaaccagcgtccagaactctggcgtaactataacggccagatcaacaaaggggaaagcatccgcgtattcccgttatccaactggactgaattggatatctggcaatacatctatctggagcagatagacatcgtccccctttacttcgccaaaccccgtccggtcattcagcgtgatggtgcattgattatggttgacgacgctcgtatcgatctgaaatcaggtgaagtcatcagccagcgaaaagttcgcttcagaacacttggctgttggccactgactggcgctgtggaatcagaagccgaaacgctgccggaaatcatagaagaaatgttgatatcgacaaccagtgagcggcagggacggcttatcgacagtgatcagtccggttcgatggagttgaaaaaacgtcagggttatttttgaggaggccagatatgcccgcacttgcacacaatgaaaccatcgccagccagatcaaacagcagggtggggtggaagcctacctgcggatacagcaggaaaagggactactgcgttttttgacctgcggtagcgtagatgatggcaaaagcacattaattggccgcctactgcacgatacccgccaaatttatgaagatcagcttgcgacattacaaaacgacagcaaacggctgggaacacaaggtgagaaactggatctggcgttattggtggatggtcttgccgccgagcgggaacaaggtatcaccattgacgtggcataccgttatttctccacggaaaaacgcaaattcatcatcgcggatacaccggggcatgagcagtatacccgtaatatggcaacgggagcttcaaccagcgatctttccattttactgatcgatgcgcgaaaaggcgtgcaggagcagacacgtcgacacagttttatcagtaccctgttgggcattcgtcacttggtcgtggcggtgaataaaatggatctggtggattatcgacaggatatttatgaacagatcaaacaggattattgggattttgccggccaattaccgactgacctgcacatttatttcgtacctatctcggcgctggagggggacaatatcgtcagtcgcagcgaaaaaatggcatggcatacaggggaaactttactggatactcttgaaaccgttgatgtgaagaaaaaagcaatggatcagcccctgcgttttccggtgcaatatgtcaatcgccctgatctcgattttcgcgggtacagtggcacactgtcatcgggtattttacgtcaaggccagcaaatcaaagtcatgccctcaggtgtgatttccaccatagaacggattgtaacttttgacggagatctgccattttctgtacctggtgaggcgatcaccgtcgtgttgaaagatgaaattgatatcagccgtggtgacctgctgattgccgttgaagatcacatgaccgtagcacgtcatgcattggtggatgtcgtatggatgtctgagcagccgctgatccaggggcaaagcctggatatcaaggttgctggcaaaaaaagccgtgggaaagtcgataatgttcaatatcaggtggatatcaccaacttgacgcaaaaagtggcggttgaattgcccctgaatgccattgggctggtggaattctcatttgatgagccactgctgatcgatagttacccgcaaaacgccgacaccggcggcatcatcctgattgatcgtctgaccaatgtgactgtcggtgcgggtctggtacgtgaaattcaaaccgaagtttacgaagagccgaaggagtacagcgagtttgaactggaattcaatcgattggttcgccgtcattttccacactggggtgcgcgtgatttactgggaggtaaataagtgtctcagatcaaggaacacacgtcttccaatgttgtttggcattcacatacgttggacagaaagcaaagggaagcggtgaatggccatcctgctttagtcatctggttcaccggattgtctggttcagggaaatctacgattgcaggcgcactggaacaggcactgttttcgcggggaatcagaacctatttattggatggggataatctgcgtcatggcttgtgcagcgatttgggattttctgaaactgaacgacgagagaatatccggcgtatcggagaagtctcaaaattgatggttgatgctgggctagtagtcttaacggcgtttatttctcctcatagagctgaacggcaaaaactacgtgaattgatgggggaagatcgatttattgaagtctttgtggatacgccgttggcgatatgtgaagcccgtgatccgaaaggcttgtataaaaaagcgcgagcaggggagctgattaacttcacgggcattgattcagcttacgaggtgccagaacagcccgacatctatttagatggctcactgcctgttgaatcattgatagaaaaattgcttgctgcgctgcacaaccacggctttctgcctatttgattaccatacccactgagccgttaagaaacacattattgcgagtagaataatgtgtttctacactcatctcatccagtacttttccatcacgttttgtgatagtggcgtcattccctcagttgtgggatgattagcgggtttttcagggggaggagatgggcaaactaacgctactattattggttttactcggctggttacagtactcgctgtggttcggcaaaaatggtattcacgattatgtgtgggttaaagatgaggttgccaggcggaatagcgctgatattacccttagggcgcgcaacaaccagctatttgctgaaattaaagatctgaaaaaaggtcaagaagcgattgaagaacgtgctcgtaatgaattgggtatgattaagccgggagaatctttttaccgtctggtgcctgatacctctaaacacaatgcgcaacaatctttgaaagaaaatagtaaacaataatcaaaatgaataacccaatatttcattctcctgctgatacttctcttgctgatattgtcgcattgatccctgctgcggggatcggtagccggatgaaatcagattgcccaaaacaatacctcccgcttgctggtaaaaccattattgaacatacattgacagcattacttgaacatccccgcatacagcgagtcattgttgcgctgaactctgctgataatcaattcgggcggcttgcgattgcctctgacccacgaataaccacagtggtgggaggatcggagcgggctgattcggtactggcagggctggattatctggcgagcctttcgacagacagttcagtttgggttttggtacatgatgctgcccgcccttgcttacatcgtgatgatctcgataatctgctacagctcatcaatagaagtgcaccgtctccggctgtctgtggcgggcttctggctgctcctgtcagggacaccatgaagcgcatggtgatgccatccgaggaagaaccatccaccattgattataccgttgatcgcagaggcctctggcatgctctgaccccgcagttatttcccttacagctattacgtgactgcctggcaaaagcgcttgcagaacaagcgtgtatcacggacgaatcttcggcactggaatattgtggctatcaccctgtgctggtacatggacgggcagacaatataaaagtcactcagccggaagatctggcattggcggagttttacctctcccgaaaatcaaaggaacatatcgtatgagaattggacacggttttgatgtgcataaatttggcggagaagggcctctggtcatcggtggtgttagcattccttatgaacaagggctgatcgcccattccgacggtgatgtggccctgcatgcggctacggatgctttattgggtgcggcggcactgggagatatcggtaaactgtttccagataccgatccggcctttaaaggtgcggatagccgtgaactgctgaaggaagcctatcgccgtatccgtaaaaaaggctatcggattggtaatcttgacatcaccattattgctcaagcgccgaaaatgctgccgcatattcctcagatgcgggtcaatctggcagaagatcttgaatgccatatggatgatattaacgttaaggcaacaacgactgaaaaactgggatttgttggccgtaaagaaggtattgcctgcgaagccgtggctttgctggtgaaggaataagtatgacattaagtgaattacactggctttatgggcagccagaagcgactggcgtagttaaagcctcaccagaagattttattgttcgtgaagatttaggattttctcctgatggagaaggcgaacatttaatgatacatatccgcaagataggatgtaacacccagtttgttgctgattaccttgctcgttttgccaaaataccggcgcgctctgtcagttacgcgggattaaaagaccgtaacgcagtcacagaacagtggttttgcgtgcatctgccaggaaaacaagatccggatttaactgcgttccagctggaaggatgtgaagttttgaccacttctcgccaaaaacgcaaactacggattggtgccttgaagggtaatgatttcactcttgtattgaggcaaatttctgacaggcaatctgtggaaaaacgcttgcagcagattgcacagacaggtgtgccgaattattttggcgaacaacgttttgggcgggatgggcaaaatcttgttcaggcacagcgctgggcggataatgaaatccaagtcaaggaacgcagccgccgcagtttttacctttctgccagccgtagtgccatgtttaataccattgccagtctgcggatcgctcaggatacgcaccagcaggtattgaacggggatgccttacagctaacgggacgcggtagctggtttgttgcagatgaacttgaactgcctgtattacagcaacgaatcatggatggtgaattgcagataacagcacctttgcctggcgacaaagcgctgggtactcagcatcaagcattggatttcgaacagcattgcctgttagattacgcatcactatggtcattggtcaaacgtgaacgcgtggaaagtgtgcgtagggcaatcttggtgcaaccactcaacctgaactgggaatggttggatgagcaaactgtcaccctccatttctcactgccatcaggcagttttgcaaccagtgtcgtcagagaacttatcaatcaggatcaaaataatgctgcggatattgctcagtaatctgcatcaatgattcattgcatctcataatgtctcattaattgttataatagcaggatagataaggattgttagtctcatgatgtctcagcttatctcttgacagcttacaaaaaacaggacaacttacaggacaacactatcttgtccggagttgtcctgtcatgccattaactgataccaaaatcaaaaatgccaaaccaaaagataagccctataacttgcctgatggcaatgggctatatcttgagattagacctactggcgctaagttctggagatatcgtttttggttaacgccaactaaagacagtcgatacactattggggagtatccgtatattggtctggctgatgccagaaaagagcgcgattgggcaaaagagcaggtaaaaaagggattcaacccaacagaggttaggaagcaagaaaagtacttggttgaaattgagagggagaatactttcaggtctatcgctttggagtggataagtaaaaaagcccctaactgggaaagcggaacgcttgaacaggtaaaaatgttcttggataaaaattgctatccagcatttggtgataaacccatcaaagaagttagcgcccatgacatcttgaaagtcttgaaatcaatggaggcgagaggatcggcttcatcagcgttaaaaattagacaatggtgttccgccattttctgttatgcagtgtcaacactcagggctgaatatgatccggccgcagccttgaaaggtgcaattattcgccccaagacacagcattcacgctgtcttcctaacgaggaaattaagctctatttcgacaggctggaaaaagctagggtctattctcaaacaaaactagcgctaggattgttgccgtttgtatttgttcgccaaactgagttaaggcaagcaacttgggatgagattgacttcgataaccagatatgggttataaaagctgaacgaatgaaaatgaaacgagctcatagcgtcccgttgactgatcggatgttggaatgctttagaaggctcgaagttctgtttggtgataatgagcagggattgattttccccggcattaatactcccagtaagcccattggagagagtacattaaacagggctattgaatacatgggttttggttctaagtacataacatgccatgactttcgcgcaactgcatcaacaaccctttatgaaatgggattcaggcgcgaagtcatagaaaagcagttagcgcatgctgaacaaaatagatccgttgctgcatataaccatgccgagtatctaaatgaaaggcgggaaatgatggaagcatgggagaggcacttgttaagcattacaagtggcatcattctttcgtgatatcttggcgctaaatccacgatcaagagagttgatataaggctgtaagtcactctctttccattttgaactgcggccatccttgagcggctttggtattaatccatttttaatttttctgtatagggttgccctgctgagtgacagaacattacaaacttgctttctgtttaataaattatccattcttaatctccttccgaataatccgcacataatatcccagcactgatttagcgctgaacctcatgtggttgagtggtttgaatttgggtgtgtacttatcgagaattgcggctactgctttgtcgtcatattggggtaggttgttgagttctttcaggcactcctttgccacctgtcgtcttccgttctcgaattcgttctgtgtattcatgatgctcggttgacaaattcgctttaatttgtaaaacggttgacgataagcagtcaaccgacactcttcccgttctcgaattcgttagtcatggatgcgacacgtgatattgcctttatgtgattccctgattcgtcccgagcgttcattgttaatagtaaagaacgcagattcatttactttcctatctttttgcttcaagaaatctgtgactaatccaaatgccatatcaaggtctttcttgttcggtacttcgattgtgactttcatatcactctctctttattattaattgctatcattatacgcgctaaatacgtagtggtttgtttatactcagcaggtgtgttggggtaaaatttatttaaaattacattttcccggcgggtaaccataagtagattatcaatctgataatttttctgattaccatctttgaaaataacaatagcgcctgctggtaatttaccgtgatgctcttcccatatcatacggtgtttcaatctccatatattaggtctgtccacttttatataaacatagccatccttgctaattctctcagttcctattgggcacatattatggggtgaacttcctgatttgaatgagcctgagttacgcttcattaaccctttagttcccgcattatgagaaatatgcccttttggatattgtcccgttcgcccggtgcgtaaccctaatcgccttctgaatccgtgaattgatttactggagtaattaacagagaaatgctcattgaatttagcagtcagttcttgcactggtaaaccgtaataaatcctcatccaatttttcattttatcagtgtatttaaactgagccatttttacccacctagaaatttaggtagagaatctacgtcttgattaccgatggcttttttaacatcaagtgccagtttcccattgttaactatctggatggcaatgtctgaaatagattttgaacggcgaaattctttttccaattgttcattcagaatattttcgtcagatagtcgctctaattgagcgaacaaatggttattcaaatcttccaatttattcttcatgctattttcctcaatttttcattgccaatatcgaatagatattctttatctaccgtggttattgttttgcgtggggtaataaatggccgccaaattaaaagcatggagcctttcggattgctgctattctttcctctcactcctgctggcacaaactgaatcctgccacccgttattaatctagtctcatctacactctccattgccaatttaaaccagcctactgaggtatcattggggacgagcatcacaatagactggcattgcttcctacattcgatggttgctttctttatccacggcgtaatcttggaatagggtggattacagaaaatagagccgtaactctcccaatcagattccaatgcgttatctcgttccgtgagatagtgggcgcacagggtattttgagcatcggcagcggcatctagtttgaatttgaattctaaatcgagtgccagaaataacgggagtggagtttgccagaggtctttcagttctttgggtgtgttactgcctccgtaatcagttttcattctccttgtccttcatgtgcaaaaatataaccatcgctgccttatatggattatcgagaaagcactccatttcaccatcattacttgcatagtgaaattttctatcccgaaatagaagacttattccatatttgataataattggcattgcctgagatgatttattgcatgggtcgtaaatgccaagtacctcctttcgcatttctattccttttctgaattcgcgatgaggataatcgaaaagcaattcaatatattgcagctcgtcattaaatctatattcacatgataaatatttttcagctaccaatttattaatttcgaaatctgataattcgctatagtccatttttcctattctcccgctcataatcctccccgcactcccgactacagaatgcaccgtattttgctggctcagtctcacaccatcggcacatcccgttgatgctggttaatggtggtttccggttctggagcgcatgagataccgtcaactcaacggcatcgttagctgtgtcgataatatccatgagggctctctatttgttggggtgggggtatagatttactgcgaatacgcttttaccatcgcctatatcattaatgcttttataaatctcaccatcagctaaattatatatggcaattggctccatattttcatattcggccagacgttttaatattgtaatatagacatccaaatctaatgttattatactggcaccttccgatttgagtttctcggctgattccaatgttgtgtttattttctcaatcaagttattgctcatttaaaccccctgcatatattggttgcccgttggcacatctcggcattaaaccaaccgaaatgacatttcctgaaactaatccccagcctccatgccagccatcggtacgcctccgtgcgttcaaaattccctctctttcgcatctgctcaaattcctgcttgccattccgcctcgccatccgtgtcggttcatcagccagatatcccaatggaatattggtttctggatgcataccgacacgtgcatcacatgaccagcagacatagaaccacggccatttgtcgtcatgccgggtcttcccaagcacctccgtgtgatgggctatctttacgtgactgcggcaatgtcggcattgggtgggaacggggagcgggtcattgaccctctgtgctgctttaggattggggttccatggggtgaactgcatgttgtgtcctcccgaattttggttgtaatactcctcccgccactgaggtggggttagttaatggttggggttagatgtttctattgggattgccgaatggctctagaatggcacgtcatcgtcaaaatctattggcggcggtgattgttgctgctgtcccggtggttgctgtggcgctccccaaaattgagattgttgctgtcctgaatgctgctggggttgctgtccttgctgacttccctgtctactatttaacatctgcatggttccgccaacatttaccgacacttccgttgtgtatctgtcctgtccttgttgatcctgccatttgcgagtctgtaaagcaccttcgatatagacctgagagcctttgcgcaggtattcacccgcaacttctgccagcttcccgaatatcacaaccctgtgccattcggttttctctctcatctcacccgattgtttatcccgccactgttccgatgtggctagggtgatattggcgactgcgccgccattaggcaggtatcttacttcggggtcttggcctaagttgccgatcagaatgaccttgttaactccgcgttgtgccatttatgccacctcctttggttcaattggttcaaactctgatttcctgagttcatatttttcctgcgcttccccttgctctggcgtgcccctaagggatttataagcctcagcgaaggcggctttaagttcatccatgttctgtgcttttcctgcgctctctgtaaagtgagttagatcaatctccgctttgctccttccatcattcaaccaatccattaatcgtttacctgtaccctcatcaatgacggtgaaatcggcattactgaacaatcctgtcctgtccttgctggctgtcgcggtgtgagtctcatgattcaagtccagaaccgtcgtgaactcatattcaacaccgtcacgctgctcggatttcattcccagcttatcaacgcgctttttcccgttgcccttatcgacctgtgccgtttccgttttactgcgcatggtggcaataatgttcacgtctgaacgcaatatcgcatccagaaatttattatgacgcggcgtgatgtcgctccatgctgaccacgtattcccgtgatattttgccttagccactccatccagcatctccagacaaccgcctgtgccattccattcatgagtaatactatcgatgatgagattatcgtatccggctgcctgtgctgcggtgatggcttcaatgaatcgttccggtgtaaaaggtgggtctaactccagtacgtcaaaattaaatctatctgagtagagagaagcacttcctttctctgtatcaatgaccgctgttgttccgcccagtcctttagcgatagttaatgccccataggttttccctgaaccgctggggccagttagcgccagtcttaatttagcttgctttctcatggccttagcaaatttcattattaatctcctgtccagataccaccatgacggcgggtcggtgaatgacccttataatggtcatattctatgtgatgagttgcgtaataatcccgccacgcctgacgctctaatttagcgcgttgctctgccatgtgccggggtagcggggggtgatttaatgcggcttcgtggttggcttgtcccgcccgctcttcacgaactcgttccgacaattttttacttgcggggtgtggggtgttatttatcattgttgcgaagaccaattccttgaggtatcgcttcttctctatcgggtctttcggcacgaaacagccatatgagcgccagtgattgctggtcatgtgaaatcccccgcgaaatcctgagcactgacggacaatccctccatacccaacacctcccgcttatattccagttcctcgtgctcggctatttgttcatccgtgtatttccgtttatgttgctcatcctgagcgtcataggggctgtagtcgtatctcatacgacctcccgttcatcctgataatggtcattgagaatcgaaataatatcctcgcgctctaagccaatggaattgcgcatgatttccttgccttcgccctctacttgccatttggtataatcatcaacgatgattacggttccgcctcgtccgtcaggctcagttttgaatcggccatcattgatataaaattttgctgccatagttacctcccataactgcgtttgagtattttcatagccgaccgccaaacgtctctagagcgcaggcgaacagcttccagtgccagttcttgcgcctgacatagaagacgtttgttgatttgcatgattgattatctgatgttggcgattaaggggttagtatgtgattttgatgtttgtcactgatcctttagcgatagcgattacgcaagccttggcgcattcttcagggatacccgcgatgattaaatcctgcatggcctgattattgactgctgaccgatgcaatgtatctgcctgacgattggctgcttcctgcttctggcgctcaatttctgccagccgtgctttttcagcttcctcagccttacgacgttccgcttcaatcgctgccagtttttcacgttcagctttcgcgatagcttcctgtttttcgcgttctgcacgttcctgtgcttctctggcttctcgttcacgcttagtcgcagcctcgacttcctgtcgcgcttttaactctgctgcctcacgttcctgtttggctttcagttctgcggcttcacgttcgcgctgtgctttttgttcagcttcgattcgcgcctgttcagctgcctgacgcttgatttcgttttcgtgctcgatgcgcttgcgttcttcttcggctttgcggaggtcatacagctcgttcatctgcaacgcttcgtcgtgatcacgttcgatttgccgggctaattcctctgctgctacacgcgccttttccgcatcttcccactcagtgaccggcttgcggatttcatcgctcagcacgtcgagttcatcgcgaaattgcttgcggttggcatccacttttttcggcagggatttcaattcatcaacgacagctttccccgctttgtcgatgtaggtttttgtctgcgttaccttgtaggccagtgatttgattgcgtctcggttctttgcttttgataaatcggtatcgagttcggattgctctgcatacgccttatctttgatgccggatataagcacctgaaccttgtcaggtgccgtgaataaatccagcgccgttgcgggttcgataatgactaattcatttgccattttttactccgttcaattgtgagaaatcctcactatgagatagcgatagggttatcgtttgttggttttgatatggcgtgttggggttatttctgggtcagactgatgagggctttggcatgtatttcggcggattcgcggtcgaggtggattaggcagcgatttaacctatcgacatcatccagatcccccaaccaaaaggtttcgtcataataactttcaccacccaaatccagaaaataatagtcctgtccttcttccaacggctccctcacgggttccggtacatcgaccgaacctatttttacagttctgggttttaggcggtattctttatcaggatcaaaatagaattcgccagccagcgacagccatctatcagcatcgtcatgcaacacctcgaaatattcccaccatttctcattttcctgtgctattccaaccgctttcatcattaaatcagcgtgtacatgtggtttagacattatctatcctccaatgacattgcaccatcttctggataatcagtgcagtaaacaccttttcctttgtaaggcctcccgtgtatatcttccattggtagattttcacatatagtgaattcttcacttaatctactttcttcaaccttttcatatgatataccagccatatcacaaacatcctgtatttgcttaattgtcagcgttatttcagacatcgttattctcctgtcggtggttgaggcatcggcatccagtgggttacgtattcatgaaataacttccaatgatcgccacttccgttatgaaagaaataatcatcacctactctattattaaaagtttcgtacactaaataatatccatcgtcatttggcaacctatcgctacatttaatccaatccataaaccctcctgttattcatccagagccgtaaattcaatatcttctaagctatcttcatcaacccaagctttttcacgaaaaaatccatttctatgaatgatatcttctaaagccctatcaatttcatgatttctcatatcggagttttctatttccagcatacggtcaaactctgttttaagaatttctaattcttggctgtaatgaactttagcgaatgcatctacatgaatttttattttctcactcattttcattttcctatattcaggtaataaaaagccccgcattggcgaggctggtgtttaagaatgcaattgcttaactataatggctgctgctattggtgggattaaaaataatgcagacaaaattgaatataaaattttgcttcttgtttttttatatgccatgaatgtaaaaagcagccctataggaaaggtgatatatccaaataccagaccgaatactgcaatataaccccaaaaaagataggagattattgccgccattgcctccatacatactccctcatgaatcccattgtcgaatccatgaatatatcagttctactcaccacagcccactcggaaatgagctggagttagtcaactaataagaataaatatggcgaattttgttagattgttgccactcagccacttctttcgcatgctcaatggcatattgttcagcagtttttttcactctaggaaagttaccagaataatttaaatcatattcagcttctttattgcaatgaacagtgatttcttctaaatactcataggatttcatagcaccagcagcttcaaaaattgattttacttggtcgatagtaattgcattcatgattaatactcctgtagtaattaaactcaccacagcccacttataaaatgagctggaattagtcaaccatagatagccattaattcgcgaatagaacgacgtttatttaacgctgcctgaacacagtgtttacgcaaaaatgaatcatgacgaaaacgaatagcagactgacgatcgcgtttcattgatgaattctttgtccatatcaccccctcgctgttactgttgttgatttgatgtgcctgcatgtttaaccacatcaggcggcagtggttttcattaaaatgccttaccgccagatttggcgcggttttctcgtttatggtctgcccgatgcctgttgtatgctaatttctcagcaatcgcgccctcgatgtcatacccaaatgcctctgcataatccaaaatacggatgacagcatcagctaattctgcttctgccataggtcgatgcggtaggtgatcatccatcaaatttttgcgttctccctccattgcttcgctaatttcagaatgaattaggcatagtaaggttccgcgctcacggggtttatcccaccaaccggcttcaacattttgctggtgaatttgtttttgtaattcagtgagtttcatctcaagtccttcttgtggggtttggggttagatcttttaggtaatatgcatggttagccactgaatagcagctaacccctcgccgtaaccccgcctgactccagtatccgattgctagctctttgcttggttgagtaaagagctacgtcactcatgcagcaagatccgccgttgttgtcactcgtgtctgtcttgagttgcgcaaacagatttgctagtgcgtcaatttcatcgaccggctgaccgaaaatactgtcccagatttccccagtcgttctgggagcagcagcccgagcttccatgcggttttgcttccgtctcaatttataacgttgtcgtgagttcatatgtcctccgcaaattgattttggtggtgtggtggtcggtttttacttcgacaatagccacgctcaaaccccctaggattaaaatcggagtcgaaccggttgccgcagccctgttcctgagatggtctagcccatcatgtcaccacaccccaaaaccaacttgttttggcctcccagtttcaaggaggaagttaaattgttaaagagcggtactacatctttggctctatgccttggatgattgaattaaacatcatgtggatttataagtcaacatgatgtggatttattttatgtaaaaatactcaatttgttgttttattgttgatttaaatgaatttattttttgttgatcagatatgatgtggaggagttggattgagagcataaaaaaaccccaataaggggtttagtcagattaggatttaggtgtgagttaataatgcaagactgagtgccagaacaatttaccgataatattcactttttcttcatcggctatttcatcttcatactcatcgcgattgtaacttctgataagaatttttcccgctggacggcgataaaggactttcaacctcttaagtccatcttgttcaatggcgtaaattttcccatcagcaatgtgtttattggctatatcaatagctacagccgcgccatctggtattactggttccatactgtcacccttagcagggaagcagataattgttgaaccgtctgttggagcgcctatccgccgtaatgttgctttggaaaatctgagcttatatccgttataatcaacactaatcacactgccattgccgcatgcaaattcgatatctttcaaaaacggtacttccacttcgttatcatctaatggggtatagctatcccatgtggaaacgcctacccattcgttttctggaggaacatcagatttagcgtagtggtgttttactgcactttccagcttttgatctcccatcccatttaataaccagtctagtgagtatccaaattgttcactgatgctttgtgcggcatctctactgatagcgttcctgctcaaccagttatttactgtttgagcactaacgctcaatgcttccgccagttgtttttgttttaaattttcttggcaaagaataatttttagtctgtctttcaaagtcatatgtatcccccaaagcgtaagataaacatcgtgtgaattttttcaatcatctctatgttgattttttttattcttaagattaacattatgttgattttatacacatggagttactcatatggatttctcgcaaacaccattgcagatagctgtgaatgctgttggtggtaaacagaaaacactagctaagttagtcggactgacaccgcaggcaatcagcaatctaaagaaacgaggcggtaatttaccaagaacaaaaattaccgaattccgcaaggcaacagggttgccacttgagattctttatccagagatagcggaataattactgctctttaacaatctactgctctccttgaaaacgggagaattattaacctgattatagtcaggctaacggttattaattaaacaaacattaaccaaatttaactttaggacattttacgaatgaaacacgcaagttaccgcaaattattcagagacaaggaaagtgaattgcttaacaagatcgcgctgacaggttcacggaacgtagccaaaataattgattttcatgaatcacaaatcacgcgctggcagcgtccgcaaaaactggatgacattagcttcattgcgaaaatggctcgcgttttggttgccattgaatatgacgcgccagacacgaacgtagtgataaatcgggaggatgcgaaggcattaatagaagcacttgagtatatccgatacccaaaaagaaaaacctcgaaggcggctaccgacgaggtcttagaaatgcaacttgagataggaatttagcggttcccgaacaccatttcaacgaggttaattatacatgaaaacgaaatttaatcacagcgctgtgcataaaaatctcacgcgcgaacgggagactcgttctgtcaccgaacagggatgtgaaaaactgcgtgatgctctggaggatgccaaattacggctggagcatcgcgaagaactgaccggagggaaacgccatgagtaacgttgcatacgctgattttggtgcgaacgcgtcttcaaggagcgcacggatggaaaaccaaaaacaggggcactttgcactgttcaggagtcttctgtccagtggatgggcggatgataccgccaaattagcattatgggttaggttattggggatggctcaatacaaacccagacgcattgaatttggtggtgttgattgggatctggatacagggcaattagtaacaaaaccccggttattagccagaaagttacgagatgccaaagggaatgagaagacccctaagcaggtcagggatatgctcgaattcttttcttcggagggaatgttaacgtttagcggtaatcgacatggaacggtgatcaccatttcaaattataccgattatcagcttgatgttgaggtaacaaacaaacccaataactataagggttcaacgcaatacgaggtaacaaaacaggtagatgattttgaggtaacaaagcaggtaactaatcaggtaacaaacaaacccagtcatgacgcggatttcagcgatggtcaggtaacaaagcaggtaacaaagcaggtcaaacagagtaagaagttattagaacaagaattaaatacaccccttacccctcacgaggggaatgacggtgaggttgctaaacctaaaaagcgaaaacccactcccaaaatcaactacgacgaatacctcaatgcctacaatgaggcggttggtgacaggttgccccatgctgtagagatcaatactccgcgccagaaagcgttaaagaaattaattcccaagctgttaacgccaaatgttgacggattcggagcctatgttcgggcattcgttggtcaggctaggccgtttttctttggtgggagtgatagcggatggacggcagactttgattatttgctgagagaaaaaacattaaccggcgttcgtgaagggaaatttgcggagaaagaccatgaataattacgattttgaatccagtgtgattggcggattgttgattagcggtctaacacctgatgccagtgatgtattggcaacgctggagccagaggcgtttgctaccccgttctaccgagaagcattcaaaaccattcgttcacaggccaaaaccagagggttaattgattctctgatggtggctgatgcgatgggtgagaatcatttcgccaatgtcatgatgactgccaagaactgccccagtgccgctaaccttactggctatgcgaacacagtttcagccaactatgaacgcagactcatgattgagttaatggacgaggctaaggaacgcattctaagtggcacggttgagaacgcggcggagtctatggactggtttatttcccaagttgcagaggtgcgtaagccacgcgatgagatccgcccgctgcatgtttctgagttactggatgattacaccgaggttttggagaaacgtctcaaaaatggcgagcaatcagacacgttgaagacaggcattgaagagctggatgagatcaccggtggtataaacccagtcgatttggtgattgtggctgctcgccccggcatgggtaaaacagagtttgcgctgaaagtcgctgagggagtcgcaaaccagacaatcacaggaaccaaacagaaacgcggcgtactgatcttctcaatggaaatggattcccagcagattatcgaacgtcagttggctggagccgctaacctgccagtatcagttttacgaaatcctgcccgattggatgatgaaggttgggattgggttactgttggcttggggcgattacaagacttggatgtatggatcattgatgccagtaaattgacggtggagcagattgcttcaatttcacggcgtcacaagaaagtacacccggcattatctctcatcatggttgattatctggggctgattgataagccaaaggcagagcgtaatgatctggccgtggcgcatatttcttccagcttaaaacgactggcgaaagacctcaaaacgcctgttatagccctgagccaattatcccgcaatgttgaaacgcgtcccaataaacgccctgtaaacgctgacttaagagattccggtagtgttgagcaagatgcggacagcatcatcatgttgtatcgcgatgcggtgtacaatgagaattcccccgcagcgccatatgctgaaattatcgtaacaaaaaacagattcgggcaattgggtacggtttaccagcgattccgcaatgggcattttacgccgactgatcaggaagaggccgtaagagtttgccagaacaatgataacaaatcccataaacgctttgctaaaggagcaaatgtatgattaaggattacacagaccatctagaacggcttgataaattggtatgggttgatgaaacccacataattttaaataccgacttgggaggaacaaacaacgagtatgaaataccgctgcacgactgtgatacatcagaaaagatactgtggtggacttttcatttgtccgaaaagaattgggtaacaacagacatgttacgcagattcatcagattagcgacggtgaaagcaaaaataaaaattgactaaaggtctctgcgggggcagagccacatacaaggacattttgaaatgaaaatcaaaacgagtgagctgacaggtcgggcgttggactgggctgtggcactggctgatggtaggggcgttaaaattaacgagctgggttatgtttttgtcaatgataaccgctctattggtgtttattctccctcaaccgactgggcgaagtgtggggagttgattgagaagcatcatgttgaattgaattttaattcagtcagcaaagaatggccggcatacatatttagtttcgaagagcttgaatatgtacttgaagacggcgagtctcccactatcgccatctgccgcgctgtagtggctgcacagttgggcgacgagattgacatccctgatgagctggtggagggggtatgacactcgaaataatggaaattaaaccaatttttatcaacggcgctccactgctggatggtgatttcaatccggtgcgtgtaacgaaaaatcaggcaaggaaaaaggcggggcaaatgcaatcagctatgcgtaaaaaatcatgggggaaaagcgctgtcggtattgtctgtgatgctggcgctcacttcaatgtgtcagtgggatttcctgaacctaacaaggtggtttgaaatgacagagaaaacacaggagttactgagttgcccgttttgtggtagcgacgttttgtcgataaatgggatccgtccctgtaattttgtggagtgctacggatgcggtcattcagtttatggagctgacgaacacgctgtaattcaggtgtggaaccagagggcaaataacgatgacagataacatcatcactctcaaatttggcgatgatagcaaacccagcattagcacctcagtgactcctaaaaccccagaacaatcccgctgcaagcacggcgcaataacagtcgatgaacaatatcgcatcatcacatgcgaccaatgcggctgcaatgtcgatgcatttgatcacttgctggaaagtgcacgtcaagccgagtgtgtggtacgagagattcaagaactataccagcggcgggatgaattgagagcagcctgtgacaatttgctaaaggaagaaaaaaacacaaaagtgaggctcaggggggcgaaaacacaactgcaatttctggaaaacgatatcaagaaggtgaataacggaggttagatgacagtcaaaacatactatctcagtaataaatccatccagcaaaacgctatcgaagccatcaagactctcccgctagaccccaagaagccctacgaaattaaactctctgaacctaagcgcactaacgctcagaatcgcaagatgtgggcgacgttgggtgatatcgcaggacaggttcaatgggatagcgagtggtacgacagcgaagactggaaagatttaattactgtgctgaacaaacaaaccaaaggcgaagcgcagcggtcagccagagggctaggcggtggcatcgtatttttcgggatgcgtaccagcaaaatgaaggtgggtgaaatagccgaggtcattgaatgtgctcactggtttggcactgataagggcgtggtattcagtgataaggctaagcaggaactggaatgggcgcagcggttcggcgataaactcaagaaggaaatggagaatgaaaaaacaggtacggcgaaaatgtaaaatctgtcggggctggttccatcccaaacatgaccatgtatggtggtgtagcccggaacatggcgcagaattaggaatgcgacggcaagataagaaatacgaaaaagccagacagaagttagaacgagaacgacgacaaaaagaagtagaagcccgcgataagctcaaaaccagacgcctagcagtaaaaccccgcagttattggattcaacaagctcagcacgcagtaaacgcctacatcagagaacgagacagagacctgccgtgtgtctcctgtggcacgtacacatcgtctcagtgggatgcaggtcattaccggacgacagcagcagcgccacaactgagattcgacgagcgcaatattcaacggcagtgcattgtctgcaaccagcacaaatccggcaatctggttccgtacagggtggagctaatccggcgtattggtctggaaccggttgaggctatcgaatcgaatcatgatcgccatcgttggacgattgaggaatgtaaagccatcagggatgagtaccggcagaagctcagggagttgagacaggaggcagcatgacattcgacaacttcaacgaggcgatttcctatgccagaaggcggcgacgggatgagaggaagcatttcgctgttcggcaacgcaaagaccgcctttatgtcactaggttgacagactgcaagcgccctgcatggtcaacattggatgatctgcgatttgagcattacggcgtaaaaccatacccagtcgttaaattagagctgtccgataccccgctcatcatcggtttactggccgctggtctgtcacagcgtagcgtggccaataaatttgatgttacacgtggggcagtacggcgattagtcaacagagtaaaacgacaacacacagtattgccggaggtgagataggatgaatttagaatcactaccgaaatatttttcacccaaaacagctatgtttagtgactctccagccgcaaccgctactgattcatattcaattaccgatgtcatggcctcgctaggattggcgtccgctcaggcgaggatgggtattgaactgtttttggcgaaacaggggatcaataaaccagatgaatcggtggagagcctgtatcactatgcactaacgcaggttcacaaacaccctgcaatcgcaaaactcgatgaggatattaaacaaagcattctgcaaatactcgcaaattacgcatttcaggattatgcgaggagtgcagccagtaagaagccatgttcagaactgcattgtgaagatgggtttatcgaagcagaggtatttacaaccaagtggagtaaacccgcgtttctggatattccagactgggctaaagaggcacgagctataacgccggaggagtggtacagaaagcgtcaggtgcgggaggtggtgagagtggcatgtaaagcctgtagcggaaaaggtgaagtcagtcattcatgccgttgcaatgggcgcggggaggtgctggataaaaaacaaaccaaattgattggtattccagtttttaaaacctgccctaaatgctcaggccgtggatactccagactgccagccgaagatgttagacgcgctatttgtggtgaggtgatggagatgcctgagactacgtggagacgaaatttcaaaccattctatgaagcattgatagaagaatgttttaaagaagaatcacgggctgatagtgttctatcaaaactaacgaaaagagaaactatttctatataagtattaaacagtagataaatgatattgacaaagtggcgaaaatagcccatcattgctctaatgatgggttattgcctctcgttgaaacagaaaagaattccaaggcctcgcactcgcggggctttttcacatctgcaatcctaactaattgaaatccatccgatgccggaattccggtaacgacatccttttaactcaatcacaggggcgaccatagctcaccccacggacgcccattgttcaaatggggtggaatatgaagatgaaagaaaatcctgatttctggatgcatcttggtgactggctcatatcggtaagagagcaaggcatctgggcaacccttgcagggacgatggcattttttcgcggtcgctataacggtggcggctgggtaaaggtttcaatcgacgcttttatgtgtgccatgttcgcctggttcatacgtgatgttttaaatttcatgggtctgaatcctgacttggcctacatcggcagtgtggtgattggttacttgggtacagacttcatcggtcaattgctgcgtaaggcggcagataaaagagcgggggtatcttctgatgaaaatcagtaaaaacggactggaattcattcagcaatgggaaggcctgaaactgaaagcctatcctgaccctgctacgggtggtatcccgtggacgattggttatggccatacgaaagatgttaagcccgggcaagtcattaccgagcagcaggccgaagcctttttgcatgaagatttgcagcccatttacatcactctggaaacagcggttaaggtgccactgacacaaggtcagtttgatgccttatgttcgtttatcttcaattgtggcgcgggtaattttgttcgttctaccttgttcaagaaaatcaatgccggtgattacgcaggtgcagcggcagagtttccccgatggaataaagcggcgggtaaggtgatgaacggtctgactcggcgtagggcatctgagcaacagatgtttttgtcatgagattctacgttatctgcggtatgggaatagctctagggatcgcgctgtatattggtggttattaccgcactgagtataagaagcagctcagtatcaacggcgaccagataaccgaaattcagcaactgaccgacaccctcaactaccagaacacgcacattgatatgctgcatgagatggacaccaaacacattcgggaactcgacaatgccaaatctgaaattgacactcttcggtctgatgttgccgctggtcgtcgcaagctgcgcatccaagccgtctgtcccgtgcgtgaagccactccctccggcagcatgggcgacgcaggaaccccacaacttacagaagcagctcgacaagattattacgatctcctccgaatgatggcggagaacgaacggcagactaagtatttgcaggattacgttaatattgaatgttataaggtgaagaaatgagcaagctagcattaccgccgcatcaacaacgtgttattgatgaaaagaaagagttgcaggaaagaattgaaaaattatccaatttcattggtgatgcaatctattacaagctagaagaagttgaccaaattcttttggatactcagttatcagccatgaagatgtatagtgaaatactatatgagcgcgttaaacgattccgattaccacctcagagcaagtgattctggggttgcaggaatatgttagggcagcattggtgagacttgaataatcatattgatagcggatattgatagagaatttcggtctatcttatttattctacacgctacattgtatatgcgctcataatgtaaatttaatgccgttacagcactaaaaacatctgaaatatgtgctttgctattgggttttatcgtcactacatcgacaaatttactgggttcataaccttcaaatttactgttatatgttaaggagtaattttggattatgctgccacctaagatatcctccggaatgtaattcgtttgatttgtaggagtaggatataaaatggcatctgccattttttgacctattgatactttaccatgaagacaattacaaactaatgtaatccgcaaggggacataagtacggccagagcctggctggaaaaaacctctttctggggtgtaaccaccatgagctaagataattccttttctggctgagtccccagcttttttaatcaccaaatttctatagtgaatagttgcaattgacatatttacttactctctattgattagcgatgtaagcattttgtctcatcatgtcaacccaacaacaagcgaataatatttaataattagttaacctctgaaactaaagtcaatatttctttgcccgttccctgagtggttaaaggaatccccatgccatcagttaacgcgggtggcttttttgtatctgagttccgcgcactcaccgcgcaataatccacacagaaccttacagaaaatcgagcctgagaaatgccgttaattggtattttctgtgggcggcatttctggtgagcaggttcgcttttctataaggaaatacccgatgaacacagcattaactttcaaagagcatgagatcactccgtttgataatagtgataacaagatttggttcactggtgagcatctggctgaattgctgggttacaaagacagcaagaaagtagcaaatctttatagcagacataaagatgagtttaccgagagcatgagtaccgttgccaaagtgaggacttcgaaagaatcaatggcttacgggtgtttgttatcagaggttcgcttgtattctttacgtggcgcttatcttatcggaatgttctctcggacaaaggtagccaaagaacttcgcatttggttactggatcttgctgagaaagaatccaacattgatatcggtacactggatatgactgcaataacgcagttaacagggcaaaagatgcacgatttgatagatgtttttaataaggcttctttcaaacaccgtggtcagaaaggaagcggcttaatggctcagcgcaaacaggatataaaaagaataaaggaagcgacaaaactagcattacagctcacccagttttctatccctgacctcggtgattttcccgatgaaggcgaacccgcatgaacaatgaacaatttatcgagaagaacgtacaggccgagttaaccaagctcggcttttcttcatctatagcaggaatggcaagtgacagagcagtagagcattaccgccgttctggttcagcgagcagaaagggtaagaagtttgaggattgcctgagtgttgctaaggcatgggcgagtaggtattcagtcgagaagcccaagaaaaaatgattatacaaaattctgtaaagcatccacattcgggtgcttgatagattattatttaaaaatgttcgtaaaatatgcagcatttagtatataaaatacgtctaatcatacctttcacatttccatagaatatactgaaatggttaatatattttgaggtaatgaaatgaaaaagattattgctgcgataattttctttggggtaatttttggaaacgctaatgcggccgaatttacttgtcagttaaaaaacaataaatatgtgaatgtatcagtggagcaaggaaagacacctgtttatagatatggaacattatctaaaactgaaattactttgccggtaaaattgaatgatagtaaaaatgtattttacggttatcagctacttataggtgggtcatcaacttatgtcagatttaaaaatggtgattacagctatgtcgtctatgcagggggaagtaaatattgggatttttcagggcttgttgtttataaaggcgataaaattatcaataaaaagtcctgcaaagattctgaatcgttaggtcttatagatataggtgaatatcatattcaagaagacccaatgattgaaaagtatagttcagctccaaattgatatttaatgcacgataattcagccctcttcggagggttttttgtttatggggataaataaatggctaaaccagattgggaggccatcgagtcggcttaccgtgaagcaggaatgcctgagttgctatatagccattttaagaaaagcggagaggcgtttctttctggcgtaattaaagttttccttgctagctctaatgcgcacataaagctatttgatggacaagtggcgccaataattcgagtagagtctgagtttccagtgccgagaggaagagttgatttcttcttagtgcatgatgatggttctgctagcgtctgtgagctgaaagatgggcgtaacggccttcaaagcgttctggctggcatcggtcaggtgatctgctattcggtgcaggttggtatgtccaattctggactgaggcatatccgtaaggttctgatgttctcacgaactaattcaatttctgatgacgctctaatcgttgaggcctgcttaaaggctggagtaatgcctgtccctattggcagtgaagatgaacacaaagaggcggcatctgccttcattgatatacacaggaaataaacatggcactcactgacaaacaagaaatgttttgtcgcgagtacctcgttgatttgaacgccacacaagcggccattcgtgcggggtacagcgaaaggactgctaaccgcactgcgtctgaaaacctgtcaaaacctgatatccagtctcgaattgcagaactgaaagccgatcgcaatgaagaggttggtattaatgctacctacgtattaaagcggttggttgaaattgaccagatggatgttctcgacattctcactgatggcggtgaactgaaaccggtaaaagactggcctaaagtatggcgtacaacgctatccggtatggaagtggttgaaatgggttcacaagataccacagcgttactcaagaaaattaagtggccggataaagtgaagaacctagagctgttaggcaagcacatcagcgttcaggcattccgtgatcaggtcaagaatgaacatgatgttgtcggaacgctatccgatatgatggacgatcttgccaaggggtagtcatgaagccggaacatttagcattactgcgcaacaaactctggcggctgaatcatctctattggattacggacaaagaagggaagactatccggtttaagatgacaccggaacagttagagtacttcgaaggcatgcacacccgtaacatcatccttaaagctcgccagcttgggtttactactgaggagtgcattattcagttagatacggcgctatttgaggcaggaaagtgcgcgttaattgcccatacgctgcctgatgcaaagcggttttttagagaaaaaataaagttcgcatacgataagttacccgatgaaatcaaagctgcaaacccagcaagaaacgatgcggcaggggagttggtttttgaaaaagggggatcgcttactgtatcgacatcattcaggggcggaaccttaaagaggttacatatttctgagttcggaaagatatgtgccaagaatcctgataaggcaagagagattgttacaggggctcttgaggccgttcctactgatggttgtgcaacatttgaaagtacggcggaagggcgagcgggatacttctttgattactgccagacggcagagaaagcccagctacagggcaagcagctatccaacctcgactggaagttctttttcttctcctggtggagaaatccactttatgcgattgatcctgtagagccaataccgccacgcttggttgactacttcgctgaattatcaggcaagcacggcattcagttaaatgaacgccaacaagcatggtatctcgccaaagagaagacgctcggcgatgacatgaagcgggaatacccgtcgatccccgctgaggcattccagcaatcagtcgaaggcgcgtattacgccaagcagttccgctggctgtatgaaaacaaacgcattggcaaattgccggacaactcacatctgcccgtacacaccttctgggatatcggggtgggtgactctacggctatttggttcgtgcgtgaagtcggagaagagttccacatcatcgactactacgagaactctggtgagggtttacggcattacatgaaggtgttgaaggacaaaggctatacctacggtgatcattgggggccacatgatatcgataaccgtgagtttggcgctgatgctaagtctcgacgagagctggcgcgtgaagggtacgaaatcgacggtcagaaatactcaatgatattcaaggttgtgccaaaggttggtgtggatactggcatagaatcggtgcgtgaaatcctgtccaattgcgtatttgatgaagagaagtgcagcgagggtatctctcatctggaaagctatcgcaaagaatgggatgacaagcgcggttgctggaaagataagccacttcatgacttcacatcacatggtgctgatggcttccgttattttgctgttgccaagaacaaccgtaaggctgtgggcgcatttttcttttaaggagagcttgtgagtgaaaaacaagaattgttcgttaatagtctggccgacactatcgccaaaaggatgatctatgcggctggtggcattagcggcaatacaaaacgaaccaatatttattctgagttcggttatcccgaacagctcagatttagagagtactataacgtctatgagcgtaatgccgtagctcatgccgccgtgcatcgtttgctggatgggtgttggcaggataatccgacaattattgatggtgaagagaaaaaagaatcagacgtaaccagcgcatgggaaacgaaagttacaaagctattaaagccgttctgggcgaaaatcaaagacgctgatcgccgcaatatgattggtaactattcagcgttgctgattcaggttagggacagcaaaaactggagtgagcctgttgatgttactgtggtatcacgactaaaagttgatgcagtagttaacctgatccccgtctgggagcctcaattgactgttgctgagtgggatcaggatattcattcagatacctatgggcagccaaagatgttcaattttgatgaacgtcctgtgggtcaggttgagatgcaaggcccagcaaaacaacttcttattcatccatcacgggtgattactttgtgcgaaggtgccgaaagtggtgatattttctccggcacgccgttgctcagggcggggtataacaaattgctggatatcgaaaaggtatctggtggtagttccgagggttttttgaaaaacgcctctcgtcagatcggggtggagtttgataaagaaactgatatgaatagtatcaccacggcggcaattcaagctggctacgaagacctcggcgcggcactggaagataaaatcagcaaactcaacagagggactgactcagcggcagtgatgcaagcggggcggttgaatgtcctgtccgttgctccgggagacccaacacctacatgggaagtgaccgctcgtgaattctgcgcatctgtgcaagtgccatttactgtgttgttcggcactcagaccggaaagttagccggtgataaagatgatgctacatggaaagttcggttgaatgggcgtcgatggggttttctgactcaatatgtaatcagattgataacgcggttgtgggaaatcggcattatcgaaccaccttcttccggtgaggtcactattgcatggtctgacatgctcgcagccagtgagaaggagaagatcgacaatatgattaagatggctgaggctgcacttaagacacaacaggcatttgggacacccgcatttactcctaatgaagtccgtactgtaggcgagctggagccactgaaagaagaaccagagccacagggtgcaacaggagatccgttgactgatgaaacagacccaaatcggaaccccgataatacccagaaataagcgcgaccctactcagtcatatcgtccagtaaataaaatgtttcgtgatattgagcggcgatattacgacatcaagaaagcattgcgtgaactatttgaccagcgactaactggcagggtgagagaaaacaacgcccaattgtcgtatatcatgcacggagaaacactgtatcaggttaacgctgacacttttatctacgatatgacggcgcaacaattggctgcattattagagcgtgtgcagaccattttggatgattatttgctggagggcataggtcaaaatatttgggcgctccagtacgtctcagaggaatatcagcgtggtacgttgaatgcgtacactaatctgtcggttcaatcatcggtgtatgagatgcagacgacgctatcagcattactgtcgtctgctgcttaccagaaccagatagcagccgcctacgtatcaacgtacagcgactggaaaggcatcagtgataaagcccgtgctgatcttgctaatgtgattgctgatgctattggtcgtggtgttaacccgcgtgaaacggcgcggattatcagtaagcggctcgatgtgtcaatggctcaggccaagaacatagcccagactgagcaggttggcgcattgcgcgaggctaattggaatgaaactgaatgggctagtgagcggttaggcttgaatacccaactgctttggctctctgccctaaaacccacaaccagacaatggcatgctgtgaggcatgggaagatctacaccaaacaagaagttgaagaattttattctagaaatgggaatcgctatcgctgctactgtgcgcaacagccgattgtcttggatgatgacgggaaattatataacaaaggtctgactgagcgcttaacggaagaacgtaaagcgtggcagaaaccggaacaaatcgagtaacactccaaagaggtcacggcatgaagctatccagcgttcatgttaaatcactggccttaaactcctccaatatctcaactgaaactatcgatggtgatgcacatattgtcattcgtggcgttgtgcccgttgttgatgatgttgtgatgaacggcggtctttatccggctggtgaaattaacaagagctacaaatcaatagaaggcaagcagatgcctttgggacaccccagcattgacggccagtatgtctctgcggatgttccccgtgcggtcaatcagtttcatgttggtgcatgggctgagaatgtacgaaaagacggtgatcgggttgtcatggatatgaagattaatcgtcggtatgcggagtctacggaaaaggggcaggttttattacagcgtctggatgacatgatcgctaacaaggaagctgagcctatacacatttccactgggctattgctacagcgtgagcagaacggcgggaagtcaaaggggaaaaagtatacatggattgcacgaaacatgcagttcgaccatgtggctattctctctcctgatgagccgggagccgcaacaccaaaagagggcgtggggatttttgttaattctgacgggcagaaagtagaggttgaagcagtcaatctttctgatgcgtccgattgcacaaacgaggggctgattgataaagcgaaatttttcttttccaacgcctctaatttttcatttgatgatattcattcagcgcttagggcaaagctcaggactgtatatcccgatgatgactggccttaccctgaagccgtctggcctgacaaatttatctactacctatccggtaaaacctaccagcaaaaatatctcatgaacgatgacggcacagccgaactcgttggggagtctgttgaagttgtgcgtaagccaactgaatacgaagtaaaaaccaataaggaacacgatccgatgaaagaaattatcatcaatgcattgaaggcaaaaggcaaagatgttgaaggtaaatccgatgccgaactgctggatgcatacagccagatgaacgctgacgaagcaaaagtcaaagaaacgccggaagaaaaagccgcgcgtgagaaaaaagagaaagaggccgcaacaaatactgatgcgatcaccacagcaataaatgcagccatgaaaccactgacggacaaaatcaccacgctggaatctcagttgaccgccaacgcagacaaggagaaatctgacaagcgcgctgccgtgaaaaccaagtttggtctggatgacacggcggttaatgcgctggatggcgcagcacttgatggtttttatgcccagtgccagacctcggcagggctgaattcatcattcacaaacaacaattcttctgaatcattcacatctatgccggagtaatagaaatggctaaaggaaaacatgtaattcatgcgggtggtgtatttactaaccccatgctgaaccgagagggtgcagcggcggtggatacgaagcccggcacgattggttattttgagaaaggaatatttaaggcctccgtggatggcaaagaacccgccattttgtatgttgccaatatcgactatctccgctgtcagacagtggatgactctatcacggcgggttcagtggtcgtcagtattcaccctatggcggggatattcctaaacgttcgtgccactgagggaacgtataaaaagggtcagcctgtgacggctgctaacggtcagattgcggctgctggtgatggtgttgctgcatttgcctatgtcgaagaagacagtatcacagcaaaagcgggtgatctggttcgcgtggtttttaagtaaggagaactgaatgttttatttttcaactaaaaaggcaaccgaaaccggaaaccttgaggctaatcaggctcagtttggcgagctgacgttagcacgtaattcatctgcgcaggcggtagcggattttatttctcgctctcgctttcgtggtgaagatgctccgcgcctcgatgcggttaatgctatcgatgatatcaagcgcctgtatcgtgcgtatgaccagactgtgctggcagagtttgagcctaacactgaattcactctgttaaatgatctggcgggattatctcgctcagtgcgtttagaggaatcagtgtatgaatatgctcgtactggcggcacgggttgggcgcatacatcaatgtctggtcagattggtgctgcactggatgcgcgttcgtacagcttcgacggcacgatggttcctattcatgacactggctttaagttcaactggcgtgaccctgtatttaacaaaggctctgctctggcttcattgtctgatgcacaggccgactctgtaaaagttgttcgtcgtaagtatctcgactttatctggaatggcttccgcgacagtgaaggcaatttcattaagtttgatgacaagacttggaaaggcttccgcgctgatgagcgtgtcgcacaagtaacactgaacgtcgatcacactacaagcacagatggccaagcaatgcgtagcgaagtaatgaaagtgcgtgacgtgctgaaattacaaaactaccagtacggcgcacagacttggtatgtatcaggtgaagtcctgtctaactgggaaaaactgtactacgacgttaaccagacccgcactgttcttgaggaaattaagaaaatcacaggcatttctggcatcaaagaagactttgagctgaaaggcaatgaaatgatgatcattccactgggcgcaggtgttatcgcaccgattgttggacaggctttcggcacggttgctgacccacgccagttctacaactccgactatgtatggcgcacatggggggctgctggtctgatggttaagcaggatattaacgagcacttctcagtcatccacgccaaaggcaagtaagggggatatatggcactcgtgaaaattttggtaacaaatctttttgccggtgccagccttcagaagttggaggttggtcatacctatgagattgatgacaatattgctgttaagtggattgacgctggcaaagcagaagcttctaaagataaaaagggagagaaattagtatttgaagtagcgacacctgcaaccatgaattttcctgagaattcagaactacaagctgaactggatgatgctaacgctaagatgctagccatgactgatgctgccaaggcaaaagaaactgaactcacagaagcattggcggctgaaaaaaaacgagctgatgatgcagagaaagctcttgcggaagcggccagaaaggcgaaaaaagatggcgataacgctgaatgatattaagccaatgatcgccgaacttggattcacattacctgattcagtgcttgagttgttattgaatcaggtgaatgacaaatctgagtgcatggtagctcatggctatgacgagagtttgcagaagcttttgcttatctattcaaccgtccgtttagcctccctgtccggtgcaagaaaaattgcctcgcagggttccccttccggtggttcccgttccttcgcttatgattccgctggcactgattatctgctcaaacaaatcagagtatgggataaacgcggttgcttatctggcttgccactggaaagcaaaacagtcggcttctttgatgtggtggggtgaatatgagcagtgtggctaattgggcgtataccgcgccatgcaccttctggaagcggctaggaaatgatgagtatggcaagccgcttggttatgaaacgccccgtactatcctgtgtgattatcaaggtggattgtccagcaaaatatctggggttggtgctgaactggttgtcaaaaacacattttggactgagtttgctgatgcctctataggggattatatcctgattggcgagtcatctaatctgaatcctatcgtggcaggggctgacgaaatcaaacacatcgtgcgctatgccgacaccttcgagcgcacggcggacgattacgccttaatcacaggggtatgatatgggcgtaaaagtcacaggcattcgtgaagcgaaaaccaagctcaatgcattaatcggtgatattcggggtcggaaagtggttcgtgccatgtacaaggcgctgtatatcggcagcgctcaggctgctctttatacgccgattgatactgccactctcattaactctcagttccgtgatgttcgctttgatggggtgaggctgacggggcgagtgggctactcggcaaactacgccgtttatgttcatgaccccaaggttaagcaaaacttccgcagggcaaccgcaaaaaaagagttcttgaagcgcggatttaatgaagtgcgggcgcagatcgataaggctgtcatggaggaattgaaatcgctatgagtacatttgaacaattccggcattatctggcaacggcagggctgattgatggtttcacggtacagatggtcacttggattgaacagaaaggcgatggcgggaaagcgcaatacatggtttttcagccatcgggtggaacggggcggctggatgatctcagtgcggatgacaatgtgcaggtaattctggtcagtggacagaacgacccacagcctgttatccagcgagcgcaggaaatccttaattatgttgcctctcatcctgatgatgattgcctgaatgctgttttcaatctcggtggtatgccgacccccatccccacacaagagaaccgatatatcatccggttactattccgctgtacatcataatcaggtcgcataacgcggccttttttatttctattaatagaggttattcacatggcaaattgcccagtagaaaccaataaacttattggccgtaatgccattatccgtattgcgcacggctgtcctgatgcagcgccagagcaatcagtattttttcgcattggtgcattgactactaaatcatttgatctgtcacctaacacactgacctcagaggcagatgattcaaaagggctggtggaaagtgtcgtcaccagcatgaacttaactatcagttttgatggtgagtatcgtaagcgggacaagaaagatgatttcggcccattgcgattgttacaggaaataccgagagaagttcaggcgggtcgtcagccctcgtattgggtacagatggattttacaggcgaaaatgccttcgttctgcaaggttatatggtcttcacgtcttggtcatctaagttcggtgctaacgaagtggccacctattccggtgagctaaaaatatccgatgccgatacggttgaatggttgatcgaagaagtcgcggtacagtcagtcactgctaatccttcgtcattgactgtacccgtaggaaaaaccggttcttttgtggttaatttcactcctgctgatgcgaccaataaaaactatactgtgacatctgataaaaccagcattgctacagtaagcaagattggtagtgtggtgacagtgaaaggggttgcagagggttcggcaaatgtcactgttacctctgaggatggcagtaaaaccgctaaatgcgcgattaccgtgactgcttaacattacaaagggtgcttgcgagtgcccttgataatgttcaggaggaattatgacacctatttttgaaattggtgagatggttatcgccactgataaagtggactttttatttcgaccttcgttctctgcaatgacgagaattggaacgcctcagcagattgttgaagcgtacacattgctcaatggtgcagagacgcaggaattaattaatcgagctgtgatagcttacggcagtcttcctgactggctgattaagttgatgcgtaagcccatatttggccggaatatcttatcaaccgcgatgatggttatacaggcttgctgtgaagatgatgcagaagaattgatcggtgagtggaaaccggggcgaagaggtgtggtatatcgaccgggcaagatgtcaattaatgacattatcgtgctggctactgagataataacgcatggagtcattggtaaggtcaaaatcaggaagctccagcgcaatgaaggcagggaagagtattcagggcagtttgtcgcgattgagtacatcaatgcagctcgcgcccacttcggtatgtcacgcgaggaagcggcgcagctaaccatgactgagtttcagatgatgctgaaagctaagtttcctgatgacaagggctttacccgtgaagagtatgatgcggttatcgatgctgatgataagcgcaccaatgagctgatgagcggcaagcgcagattggtgagtatgaagaagtgatagcagccaatccacagatgactttaattatctaaatttttgtatatacagatttaataatcatgtaatgcattttatctattgatgatacaaaactcatagatacttatgagtctttttgagttgtttggatctgtttcgtggtgtactctgtatatacagattaaccataggttaaagacgccgatacatgaagctcttgatttcatcaaacatcagattgaagttggcagacaaaaacccgcctgttaatgaagaagatatactccagtgtttttcgaatcgggttggatacttccttgaagacacaagggaagataacagaactgacccgccgactaagtggtttatatctgaaactgattatggtgttaagttaaagatagtctttatttattacccagaaaaaggggttgctataaggacggcttatgcacctaacgaagatgaattaagaatttacaaaaaatacggcctaggaacagagaaatgagcaaacaaactgataagcgaacacacctgatagcttccactaatgacgcgtgggataacggtgagcttggatgcagtgaagctcacgttaaagtatctgatgacataacagaagatctgattaatgaagcgttggacttacagccaatttcaatcagattaaataaatctctgatagaagatttgaaaatgatagccgaccttagtggtttaggctatcagccattaatcagacaagttttaaatcgctttgccaatagtgagaaaaaacggatactcgccgaagctcacagtagggcgatgaagaatgaaaaaagaaagccgcctaataaacgtcacaaagcggcttaactcaatagcagaaagctgttccagatggtgcattatgagtttggtgttaacagtataaatgagctaaccaatgaccagtttccctctgcaatagagtatctggcgactaaagcgattgaaggtgagttcttgggtaaagaaaccttaccgactccagaggttaagcagcagatatctgatgaagatttgcaaactctttgttgggggtggagattcctagcgagaagcattgaacatatggctaatgtttaccctgtattaaagtcagcagagcacgagctagcccctatttactgcgaaataccaagagaaggcgcagagatagagaagatggtgaggaagattcttgaaaatgtgacttcacatatagaagtcacgccgactcaagacaataactggaatatactaaataagctcagaactccgaactatcactaaccccaagccaaggatggctttgaatcaaataaccatcacataaatgccacttaaatgtggctttttgcgttcttttgcgctaattggttggtattgtaagcaaaatttgatgatggggatgtgtgatgaaaataataccaataattactttggtaggttttatatattctatgccatcgtttgctgatgattgcattggcgatggaatatatcaagtatgcactaagtcaagccaaaatacgcaaggagatgatgttattgagtcatatgactcagaaggtaattcatactctataacatcgggattaagggagagtagtgacggctcatccgaggttttttctgttgatagtgagggaaatcaattttcaattaaaagctggtgtgatgatgcaggttgtcacagtagagatagcgatggtaacacctgtaccgtaaccatgtctggcgaaatgattggctgctgaggataaaaaaatgataaagaaattattggcggtggtggtattggtttctgtgagtttttttgctaaatcagcaataactgataggcctttaactcaacaggaaataagtttggttgagtctgaagtaaaagtgagccttaaagatcctgacagtgcaaaattcaaacatgtcaatcttatacaaggtagtgaaaattcgatagatatatactgtggtaaggttaatgcaaaaaactcatatggtggatatgtcggctttaaaccgttcatggtaatactattgacgaatcaaaaaaacgaaagaaaggctatggtactaccagaaggagaggaatcttcagcaataaaggaaaaagccatcatgaagcagtgtgctaatcatggttactagataaaattccaatcatccagaaccctgccaaattggcggggttttcttttttcaggagccagcaaaatggcagatcatcaggtaggcaatattgtttatcaagtatcaatggatgtcgcgcaattactgaccgcacaaagacaattagattcgcgcatgggacaggtagagcaacgttttaatcaaacagggcgctcagtgcagggggcagagaaagcattactaagtctgtcaagggctgccactgcggtaacagcggcattgtccatcgagaaaatagccagctatgcggatgcatgggttgtggttaataacaaattggttaatgccgttaaaacaaatgaaacgctggcagaagtgactgagcgtgtattcaatatagcccagaactcccgtgcgggtttggatgccactgctgcactgtatggtcgccttgaaagagctacccgtagttatggaatgtcggctaatgatgtggcaaagctaactgaaactgtggcaaaagggctggttgtttcaggtgcaaccgctacggaagcatcgagtaccatgattcagttttcacaggctatggcttccggtgttcttcgtggagaagaatttaactccatgtctgagaacgggagccgtttaattgcagcgttgagtgaccatcttggtgtgaatattggtcagctaagaaagatggcggcagaaggtaaattaactgccgagattgttgccaaagctcttctggctcaggccggaactatcactaaggaatttgacagaacatcagcgacaatgagccagtcaatggaaatggcggcgaataatatgaccaaattctttgggcaatcaaccacggcgcagacagcactgaaagcgtttaatagtactctggtgacagtcagcgaaaatatggatcttgttgcgggcgctgcaactgctttagccgttgttatgggttcgcggatggttggtgcgatgacattagctgcgagcaaaaaaataacaaatgtcagggcatctatagcgctcgcacaagctaataaagtggaagcagaaagagcattgtatgccgccaatatgacattgcgtaaggcagaaatggataaaattgctgcgattgaggcgttacgccacgctcaggctgaatacgcagtagtaaaagggactgatgcggccacagcagcacttgccagactaaccgctgctcgtgccacagcaacgacagcaacagccacatacggagccgcacaaaatgcagttactgtcgctcaagcggggttcacagcagccgcaagagccgcgactattgcagtgaatggactcaaagcagctatgtcatttttaggcgggccacttggcgtagttatgctggcagcagcagcgctttattatttccatcagcaagcggaagacgcgaaaaatgaggccaaagatttatctaatacggttgaaagtttgactggcaatctaaaggaactgagtaaagttcagctcgaggcaaataaagttaagttagaaaggaagttagctgatcagagtgagcaggtaaaaaaacaagaagtaaaagtaagtggtatccaatgggaagttgataacaatggcggctttatatactcaaaaaaatccaaggaggaaatggataagctcagggaagatttagccttagccgaaggtgagcttgaaaatgtgcaaacggtcgaaagtaattacaaaaaggccattgatctaaccagtaaagccattgctgaaaacacaaagctgaccaatgagaacacggatgccaataagaatagaaatggggaagttgatcaggcatctgacaaagcggcggattttatcaccaagctcaaaaatgaaaatgagttactcaagactcaaaagggattaaagcgagacttaaaagccgcagagttcaaggctaatgagctaggggcaagctctgggcaaaaagaagttatagcaaaggaaatcaaagaaaacaaccaactcaaggcagctgaaaaggaaagagaggacgcggcgagagaagcggaaagtgcagctaaaaaggctgcggatgatgctaaaagacgtgccgacgatattactgaggcgctttctaggcaacgggaagggatagatagactcaaaactggttatgaagaagccagcctcgaaatggctaaatacgatgctgctaaagccatgccggaaggttctagcgaggaacagattgaaaaagctagaagaaatgccgcagaaagatacgagcttgaaaaagatgctgatgccagaaagtgggatcttgaacaagactctttagcgaaatccaagaaggcaatggatgaagaacttgagcacttaaggcgtgtcaaagctcagggattgctcgaagaagaagacttcaataaacgcaagcaagagataagagagcgttataagaataagcaaacggaagatgaaattaacaaaaaagttgattcatcagtgggctttaatgatgggttgctaggcaaagcagatcctatccaacaactccagaatgaatacgctcaaaaaatggcattgctggatgcttataatacacatgatatcggcgaacatgaacgaatcctgcaactcaaatctgatttaacccgtaaattcaatgatgatatgactaccgcccaatgggagcaatggaaaggccagaatgagatgtatcaatttctgggtgatgccatggaatcattggggcaacgctctgccaattccataacagggctgctaaccggcactcaaagcgccaacgatgccatgcgaaaccttgcattaactatcacaaatgaggctgtttctgctttggttcaaatggggatgcagcaaatcaagaacatggtgattggtaaaacattagcgacagcatcgacagcaacaactatggttcaggcggctgcggctcaagcggcatgggcacctgctgctcttagcgcatccattgcaacattgggagcggcggcggctacaggcaccaccgcttacatgtcttctttggttgcaagtaaggcgtttgcaattgctggtgctcgcaaaaatggtgggccagtcagtccgaacggtgcttatcgaattggtgaagacaataagcctgaaatattcaaagcgaataatggtcatcaatacatgataccgggtgacaggggtcaggtgattagtaatagggatatggggaaagggggtggtggagtttctgtcggcgatatcaatatttcgtttagtgtgcagacgcaaggtaacttttctgaacaggatgcgcgattaatgtcgggaatggtgaaaaaatccatttatgatgtgctgatagatgagcgccgaccgggtggaatgttaaatgaatgacctatcttcggatgggttttttattgggtgaaatatgacaaaaacagaattcaaatggcgacctcaagataattatgaggtttcccatgagccgcgcgttagagtcgtgaaattcggtgatggctatgagcagagagtcaaggacggtatcaataatcagttgaagcgctatcaactcagttttgttgagaaagtggatacagggcgagccattgacgagtttctgcgagtcagaggtgcagtcgaatcattcacatggcgaaccagtgacgataaccaactgcgtacttttgtttgtcgttcttggacggtaaacaggcagcgggtgatctggtctatcagttgcacctttgaggaggtagtagcgtgagagacattccaaaagagatgcggattgaagttactgagctgagtcagaacgccattcttaatctctatgaaattgatttaacggccttcggtggggatatttatcgctttcatgatggcctgaatgggaagctggagcctgtcgcctggcagggaatgcgctatgaggcttaccctgttgaagcgtcgggttttgagatgaatagtaaagggccaagcgccagacccaaaatgatattcgccaacgtcaatgggttcattactgcaataaaccaagacttcaatgatgctttgggcgcggttgtgacacgtcatcaggtgccggaaatttatcttgatgcggtcaatttccctaatggtaatccacaggcagacccaaccagagaagccgtgagcaagtacctgatagagcaaaagcaagattccaacgctgacttcgtaacttatgtgctcgcattacctagtgaaaccgatggcgctttaattccggcgagagtgattcaagcagatatttgtagctggcaataccgttcagcggattgtggttatgatggcccacctgtggccgatgagaaagatcagccaaccactgacccactgaaagatcgatgttccaaaaaacccgctggctgcataaaaagatacccccgtcctcaacccatgccctttggcggctttttgggtgctaacaagctaggataatccatgattgaaacagacattatcgcccacgcgaaagcggaaggggtgagggaatcgtgcggcctgatttcaggtaatcgttattttccatgccgaaatatttcgcccgatcctgagcactactttgaaattaatcctgatgactggataacggccgagtgctttgcagatattgataccattgttcacagtcatccaaacggaaagccccgcctgagtacaggagacagagagcagcaagttaaaactgggttgccatggtggttagcttgcggtgatcgggtgcataagtttaaacctgttccccgattgctaggccgagagttcattcacggtaaacaagattgctattccctcatccaagatgcctatcatcttgctggcgttgagctggacgatttcagccgtgacgatgaatggtggaatactgggcaaaatctttatctcgataatatcgccagtcaggggctggagcaggttgatgagatacaggaaggcgatgtcattcttatctgcttaggtagtcagacaccttgtcacggggctatctatatcggcaatcaacaaattctacaccatcggccagatcgcatcagtaaacgcgatatctatgacggttattggctcaagtacacacattcaatatggagacataaacaatggtcaagctacagcttggaggccatcttagaagatttggccgtcgctacgaattagaggttcgcgatgcagcggaagccgtcaggtgcttgtgctaccagttgaaaggtttccagcaagcgatttctgatggtcatatccgcgttcgtattgctggacgcgacatgacagaaaaaagcgttcctgctggtatgaaccatccgcttaatgatggtgacatcgttactatcgttccggttgtggggggtgcgggtggtaatggcgttggcatggctattctgggtgtggtggctgttgctgcggcattctggacgggtgggggatcattagctgcatgggcaagtgcgtctggtgcagcagctacagctgctacaggcttagcaattgcgggtgttgccctgatcagtgcagggttggcctccatgttaaccaaaatgcctaaaggccctgaaatgggttcgagtaaaacggacggaaaccagtatttcaactcactggaaaatcgcatcgggcagggctatccggttccgattgcatacggtgagatggttgtgggttctaatgttatttctcaaggtctggagacggaataatgggtaagggcggaggcggaggcaacacgccaacattggttgatgacaatctaaaaaataaacagtacctgagaattgtcgatctgattggtgaggggcaaatagaagggcctgtgggcggtctgcatgggttcagggttaatgggactcctgtcgttgataaaaatggcaatcccaatattaatggtgtcactgtacagtggcgcgcgggtactcaatcccaagagccattaagcgattatccatttgttgaaagtgagatccctgtcagtgttgaagtaaaaaatgccactccaattctcaggatggtttcaaataaagatgtagacagagtcagattcactttgggcgttagtcaattagttcagacagatagccaaggcaaccaaagtaatagcacggtacaaatggctattgcggtgaatgatggaggaggatgggtacatgcaaagaccgttcagataggccccggcaaaatcagtggacagtatttagaatctcataccatcgatgcacccaagaaaaaaccgttccaaatccgcgtctcccgcttaaccgatgacagcaaaacagaccagctccgcaatggcactgtgtgggccagctataccgaaattaccgacaccctgatgagttatcccaatagcgctgtggtcggtatgcgtattgatcggtcattgtttgcagatacacccaaacgaacctaccacatcaaagggatagttgttcaggttccagataactatgatcctgagacccgtaattacaagggcgtatggacagggcgatttaaacctgcatacacgaataatcctgcgtggattttctatgacttagtgactaatacacgctatggcattggtaaattgatggggtcatttggctgtgacaagttcgcgctgtatgccattgctcaatattgtgatcagccagtccctgatggatttggtggaactgaaccgcgcttcacctgtaatgcgtacatagcgactcaacgtaaggcgcgggacgttctggatgacttggcttctgtctttcgggggatgcaggtatggaatggattacagcttacaacttttcaggataggccatctgatccggtatggacgttcactaatgctaacgtggttgaggggaaatttaacgttagttcttctgcaaagaaggcacgacatactgcaattgaaatcacttgggttaaccctgagaacggctggaaagatgagagggaattaattcaagacgatgaactggttgctcgcctaggtatcaatgtcaaaaaggtcatcgcatttggttgcaccagtcgcggacaggctcaccgagttggtcggtggataattgagactgaaaagctggaaaccgattcaataacattcagtaccggtcgggagggtatcaactgcataccgggtgatattgtcgagatagccgataacagtttcgctgctgcgcgtgttggtggacggatcctttcattctcaggcaaagaggttcgccttgatgcgcctgttgagtttgccaagggggaatcgggctatttctcttacatggggagtgagggaaaatttgttagggtcgatattgatactgttaatggtgatgttgtcaccttgaaagaagtacctgcgggattgcggcagtggggcattttttccatttccaaaaaatcactggtgactcgcctattcagggtgatgagcattgcagaagacaacaagacgggcaattacaatttcacctgcattcaacacgagccacagaaagaagcgattgttgataacggcgttgattttcaggggagtccagccacacagaatgttattcgtattcccaatattgagcgattaagtgtcgcttatattcaagacagttctcaggtgcaggctcgcgctatgtgggcgaccaccacaatcaaccgaaatatcacctttgatgtggccgtatatcgtgacaataaagtggtatctcgcggcaatactaaggaactggaatattattttaacggtctggatgctggcgtgtatatggttggtgttcgcgcccgtgacgacaatggaatgctgggggatgaatctaaagtgcagatggtaattggcgctcctgccgcaccttctgttgtcaatattgaacccggattttttgagttgaaagccattcctcatattagcgctccaaagactttagatactcaatttgaattttggttttccgagagccgtatttccaatatcaatgaaattgaagcaaaagccgattttctaggcattgcaaaattttggataaagggccaattgaaggcggacacgccatattggttttatgttcgcagtatcaatgaatttggtaagtctcattttgtcgaagcggaaggaaaaccaaatgataatgctaaggatattttagaggttgttggcgaacaatttctttccaacaaagccggccagcgtttgcagtctcaaatggactttaactccgaagccatcatggagattgccgcggtggaaggggcaattgttcagcgacagttgaaagtgaatggtgagcttaaggccgagatactgcacgttcagaccacgcaggttacggacagagaagcctttgctgaggacatgaagaaggtacaggccgaagtcggggagaatgcggcggcggtgcagacgaaggcgacggcggtctttgatattaagggagatgggtatgctctctatgacgtgggtgtcggattaaagtacaaagaccagttccataaagccgggatggtgatgggatctgaggtgaagaacggacaggtcactacctccatcggatttagtgccgagaatttcggttggtttaatccggccagcggcaaaatggagccgtttatgatggcgaaaaatggacagttgcttgtgagggatggatttatagaagatggcagtattactaatgccaaaattggcaattacatccaatccagaaattatattactggccgggcgggatggaaaattgataaagggggtggggcagaattcaaccatgttactgttcgtggggagatacatgcaaccagcgggacgttctcagggacaatcaatggcgctgatggccgtttttccggcgcagtatatgcgaccaaaattgtaggtgacgtggtgtctgtcacgttggggaatgtatcattaggcaaccgtgacagcattttctttcataaaaggctaacggaatccatgccgtttgatcgggtttttatttatggaccgataatgactcagctttacgtcggatctttgggtggttcagggggagcattcgtttcggtatacgttaataatgcgtttgtagctgaccagtattttagcatggagtcttctgatcgcggcccgcagtgtatttccggcacgttgtttacaccccctataaccatccccgccaatacaacgccgaccattaaagttgttctcacaacccacggcgcgggcactacatactctactcccggtattggtatgctgtttaaggtcagtagtcagtggtctaacatgtagtacaccttaactaaatacacagccggatagtttatatagacaccgccatttacgactaagagaaaacaaacatgatctactcagacggcacaacgaatctcgtgtcaggctcggctattgtccggggaacgggcaccaaatggaaaagtaatattaacggcattgccgcaggccagattatctccattcaatccggcaatacggtgattcagaatgttatccagtcggtgaattcagacaccgaactggtactggcctttgcgccctcagtcagtcttaacaatgcgaaatatgttatctcaaccactgtcccggataccgtttccgatggtgtccggcatatatgcgccattaacgcctatatcatcctgttcctgcaaaacatggacaggtggatgagtgaaaacggtaaggttgaagtggagatgccgaacggccagaaagtcacgctggactccatccgggcattgcaggcagctatggatgggaagctggttaaggagcagaacggggcagacattccgaacaaaccggcgtttgtagaaaacctgggtttatcgggaacggtggagttggcgaaaaatgcgctgccgaaagcggggggatggattgatggtgatgtcgctgtacgtagtcgcgatgctgcgttgcgattatgggctgacggtgactccggtttatatatgacctatcaccaaaatagtaagcgttctgcgtggatgggttatggcagtgatggttcaaaaacatttaccattagcaacgaaaaagccggttcaacgatttctctggataaaaatcatgccgctatttatggtgcacaaagcttcattatcagttcaggatatgaatatagtggcataaatataacgaaaccatcagggacgttttttagattggagacagataccgatcagtctgtctccatcgttaattttgtagacagaaaccccgacaactcaaatcgcagtgtacaatccctacctaaaggaaacggcacgttattatctttaggagctaactgctggagtgataacactggctatatacggccatcctcacccatcatccaaatctaccccgatggcaccttcatcaccaacgacgaatccgaaggtgcgacagtcaccaggctcggccttggacactatcagatatccggtatccttggctataacgctgacggtgcatggggtgttcatggcggtatcagtgtcccccgtgacgtcaatggcaatgagttagtgtatgtcgaggataaagtgctgccggatggggctatcgaaattaaggtgactcaccgacagagcgcgcatatgcccgcccgattgcagaacaggcgcattaagtcacaggatgagcagacccattacacggatgatgaaccctgtgatttacccgctggcacccggttagacgtccgtgtccagatgccggaggattctatctggaaccagaaacaggtattggcatctgatcctcagcaggagcatagtgccacgtcagccgtcaataaatagccaataggtgagattagcgggtagttgggtggattggtgtgggatgtgaggctggtaaactggcgggtggggtggttggatggtaatctatggcgcttatgattgcgtctcacttcgttagattctttcctttatataggcaagcatcctctgctaagatcaatcgatttcttaacagccaaacattgtctgattattggtcactccaatcaaataggacaacatacaggacaatatatagtatccacttatgctactcttaataaaatcaatgagatataataatgctgcggatattgctcagtaatgatgatggtgtcaccgcaccgggtattcaaaccttagcggctagattgcgggaacactatcatgttcaggtgatcgcacctgatcgtaatcgcagcggagcatcgaatgccttaacgctggatcgtcccttacgtatcaatacgctgaataatggtgatattgccgttcaggaaggtacgccgacggactgtgtctatctgggcgttaatcgcctggttcttcctcgtccggatattgtggtttcaggaatcaactgtggtcccaaccttggtgatgacgtgatttattccggcacagtggctgccgcgatggaagggcgtcatttaggattaccggcgctggcggtgtcactcaatggtgataaacattatgaaacagccgcagaagttacaatgcgcctattgaacctgctgcaaaaattccccttaagggcaggcaatattctgaacatcaatgtgcctgacgttcctattgagcagatcaaaggttttcgggtaacacgatgcggcagtcggtgtgctgctaaagaagtttacgccttggaagatcccaaaggtaacatgctttactggatagggcctcctggcgagaaacatgacgcagggccagaaacagattttgcagcgatagaagacgggtttgtctccattactcccttacaggtggacttaaccgcttataaggcgcaggaattaatcaacgattggttggtaaaagtcggggatatgggagaatgctaagtcggtcaatgaaaaatttgctgactcaattacgccagcaaggaatacaggacgagcacttgctggaaattatcgccagagttcctcgggaatgttttgttgatgaagctttggcgcataaagcttatgaaaatacggcactgcctattggacatgggcagaccatatcccagccttacactgttgcccgcatgacagaactgttgagcttaactcctgaagccaatgtgctggaaattggaacggggtctggttaccagacggcgatactcgcccatctggccagacacgtcttctccgtggagcgtattaaaggtttgcagtggcaggctaaacgcaggttgaagcagcttgatttacacaacatatcaacccgccacggtgatggctggaatggatggccgtcaaaagggccatttgatgccattattgtcacggcagcgccgcccgaaattccacaggctctgttgtatcaacttgcagataacggagtgatggttttgcccgtgggggagcgctctcagtcgcttaaagtggtacatcgttatggcagtgattttcacagcgaagtgatcgaatctgtccgttttgtacccctaattcaaggcgaactagcataatctgctaatttattttgtcattatttttaaattggctgtcattttttctgaagttaagcaaaatattttgccttaaatcttttgtaattcgaaatttctttataaatcattatgcttaaaacttatatttgcctttacgggggaataaggtatgaatttaggaaactcagtgaaaaaaataaagtggataagctctgttatgggagtggtgctggcaggctgtagcaatacatcggatcgtccagcgccgatagtgagtattgataagcaggaacaaaatagagggatcccttccagaacctcgtccatctcgacacccatgtcatcttccccttcaaccatttcagtaaatcgttcatcagagcatcgtgcttcggaaaatcgttatttagtgaatcgtgctgttgaaaatggctcacatcagggacggatcgtctataaccgcaattatgggaatattcctaaaggaagctatagcggcagcacctatacggtcaaaagtggcgatactttgttctatgttgcatggattacaggcattgattttcgtgatctatctcacaaaaataacatttcagagccttataacctcaatgttggccaagtcctgagaatgggtaatgtaaactccagtaacggtgtattactagcatcaaatagcacccaatctaaaattgagcaggttgattttcaaaaaagtaatgcgtatcctgcaaacattgatagacagagttccgaaaagatgttgccaagaaaagcaatttctgttagcgaaaattccgctctgaaatcatctccggcaacagacataagtcctagcagcaccatcagcagtaatagcagtagttggggatggcctgcggaagggaaagtgtttgaaggcttctcggattctaagggtgggaataaaggcattgatattgcgggtagtcgtggccagcccgtttttgcaactgccagtgggaaagtagtttatgccggaaacgcattacgtggatatggaaatctcataattataaaacataacgatgactacctgagtgcctatgctcataacgataccatgctggttcgtgattcgcaggatgtccaggcggggcaaaaaattgccactatgggtagtactggaacaagtttagtcaaattacattttgagattcgttacaagggaaaatccgtaaacccgctgcgtcatcttccgcagcgataaaccagggcaggattctgaattcctgcccgcattatcatgggtaggagcagctgatgagccaaagtacgcttaaagttaatgagttgtatgatgaggcggatttagacgaacatggcatggaagccgatgactttgatgaagcgttgctgaaagacggggatgatttaaccaatgttgatgaagatttggatttgttgcaaggggttaaccaacgggttctcgatgcaacacaactttatctcggagagattggtttctcacctctgctgacagcagaggaagaagttcttttcgcaagacgggcacttcggggagatattgctgctcgccaacgtatgattgagagtaatttgcggttggtagttaaaatatctcgtcgatatagtaaccgagggttggcacttttggatctcattgaagaaggtaaccttggtcttattcgtgcggtggaaaaatttgatcctgaaagaggttttcgtttttctacgtatgcaacatggtggatccgccagacaattgagcgggctattatgaatcagacacgtacgatccgtctgcctattcatattgtcaaagaattaaatgtttatttacgtactgcaagagagttagcccataaattggatcatgaacccagtgtcgaagaaattgcggaaaaactggatagaccggttgatgatgtgagccgtatgatgcggcttaacgaacgcattacttctgttgatacaccaataagtggggattcagataaagccttactggatattttatctgatgaaaatgactcagggccagaaacaaccattcaggatgatgatatgaagcaaagcattgtgaagtggttgtttgaactgaatgcaaaacagcgtgaagtcttggctcgccgttttgggttgcttgggtacgaagcagaaacattagaagatgttggccgagaaatcggtttgacaagggaaagagtccgtcagattcaagttgagggtttgcgccgtctcagagatatactgcatactcaaggcttgaatattgaatcattattccgcacttaaatatttatatccaatagatttcaagttgcaactaataaagtagcaacttgaaagatgaaagagatattatggtttaaccaaaaggtgggctaaataagcccaccttttatttatcttttattttttatctttcttggttctaacagacgggtattagacttcactgttacaccatatctttcagacgataaatccactccagtgcctgacgtggtgtcaatgtatctggattcagattttccaacgcttcaactgccggagatgcttcttccgtcagcagtgtcaactgcggcgtatcgacgtggcctgctgtcgcattgttggagagagattccagctcctttaatttctggcgcgctcgtttaatgacatcacggggaactcctgccagagaggcgacggccagtccataactcttacttgccgccccttcttgtacactgtgcatgaaggcaatggtatcgccatgctcgacagcatccagatggatattaaccacaccttccagtttttcaggcagcgtcgtcagctcaaaatagtgagtggcaaataacgtcatcgccttgatgcgattggccagactttccgcacaggcccatgcaagagacagaccatcataagtggacgtaccgcgcccgatctcatccatcaagaccaggctatgctctgtcgcattatgcagaatattggcggtttcggtcatttccaccataaaggtagaacgtcctgatgccagatcatcggaagcgcccacgcgggtaaaaatgcggtctacaggcccaatcagcactttctcggcaggaacaaaactgccgatatacgctagcagcgtaatcaaggcggcctgacgcatataggtacttttaccccccatattcggccccgtgatgatcagcagacgacgctgtgacgaaagcgttaatgggtttgagataaagggttcactcaagacttgttcaacgacaggatggcgtccacccgtgatttgaataccggttttatcgctcagtgtcgggcaggtgtagtttagcgtctcagcgcgttcagcaaggtttgccagcacatccagctctgacaatgcttctgcgctagtttgcagttcagccagatgaggaagcagcagatcgaatagctcttcatataacgctttttcgatggcgagagccttgcctttggaagtcagcaccttatcttcatattccttcaattcaggaatgatatagcgttctgcattcttcagcgtttgacggcgtacataatgaatcgggactaaatggctttgcccacggctgacctgaatatagtaaccatgaaccgcattgaagccgactttcagcgtatcaatgccgagtttgtcacgttcgcggatctccagtctgtccagataatcactggcgccatcggctaatgcacgccactcatccagttcggcatggtaacccggggcaatgacaccgccgtcacgtaccagaacagggggtgtttcgacaacggctttctccagcagcgtctgtaattcatcaaaatgaccgacacgctgttgcagtgcctgaatataaggtgaatcagatgatgccatgatctgatgaatatcgggcaattgctggaaagcatggcgcattctggccagatcacgaggacgggcggagcgaagagcaagacggccaagtacacgctctaaatcaccaacctgacgtaaaaacggctgtaatttaaagccaatctcttgtaaagctgaaatggcctgttggcggttttccagcacttttctgtcgcgaattggggtatgcagccagcgtttcagcatgcggctgcccatgggtgtcacacattgatcgagtacagaagccagtgtgttttcagtgccacccgccagattttgggtcaattccagattgcggcgggttgcagcatccataatgaccgtttcttgctggcgttctaccgtaatattgcggatatggggcagggcggtacgctgggtatctttcacatattgcagcaggcagccagccgcgcgcagtgctaacgtggatttttccaccccaaaaccgatcaggtcacgtgtaccgaattgcaaattcagttgctgccttgctgtatcgagttcaaattcccacatctggcgacgacgcaggccattacagcgttcaatcagtgccatggggccaaagctttcgggatagagcaactctgcagggtgggtacgctgaagctcggcggcaatggtatcttcgtctgccatttcagagacgcggaagcggccggaggtgatatccagcgtggcatatccaaacccttggctatcatgccagatagcggccagcagattatcctgacgttcgtgcagcagggcttcatcggttaccgtaccgggagtgacaatgcgcacaactttacgttcaaccgggcctttgctggtggcaggatcacctatttgttcgcagagcgccgctgattcaccgagctgtactagttttgccagatagttttcgattgcgtgataaggaacccccgccatcggaatgggctggcctgcggattgcccgcgtttggtcagagaaatatccagtaacttagcggcttttttggcatcgtcaaagaacagttcataaaaatcccccatccgataaagcagcaaaatgtcaggatgctgagctttcaggcgcagatactgctgcatcatgggagtatgactgtctaaatcctttgctggtgattctttcatattgatcgcattcaattttactattcctgttgactcagttgggccatcgacgctcagccaacccatctaaaatgacaaaacctaaatataatcagctaaggatggaacgctaatgaacctcatcctaggcgaaaacgttatcttatcactgataatcggtgtgatcattaaggcttcaaaccagccagcagtgaccaagtatggcaaaacgtgacagggaaagtttaggtggtaggctatcaggattgcaattgagaatgtataggattttttggctattgatgaggattgggaagcgactcgattttatttttactcctaaaaattcatcatgagtaatattcttatatttaatcagatagttttgagtaaatggtgtttacagcataattaaatgaatgagaaacaaaaagagaaagaacatcgcaaagataataactacccagcagaactgatagaaagggtatgagttgccaaagttgaccaggccgcgaagaccgctatcgtgaaggcgttgggatagctttcggaacatcactatatagataacgctatagagaggccaaaggacaaggacgcttctggccagctttttaccgcctatcatgccgagtatcaaggcgatggcaaaaaaacctaatacggcacgattatcaagttgttttaaggaagcaagagtttgtttatcttgctttttcattgcatattttgaaagcaaagcagtaatatccctatttttcagtttatctattttaaccctatccaatccaaaaacccattttcattgatgattggtagcatgaatttttgaagattacgtggaagaaattactaacaggctttgctatctttgactgctcaccattattagtaaagtgatgagttaaagcagtgctatgccaaaatataatgaaaaggcccattagggcctttttacttcattacggttcggaaatagggaaccagaaataaaaattatccatataagataacatttctttgaactttcctttttgtccatcgatttgagcttgtccgctttcaagcaattcatccagcgtaagttctcccagcgccactttaaccagcgttttacgatcaagtatgatcgtgctgtcaactttttcagcggttccaggcaggtaattcatgacaccgtttttcacagttaaagtatatttctcaccgacatctgggaaaatcaagttgaaggcgtaatggtggtcgcctactttgggtccattcaaatgaatggctaagaaatcgaagaacattggaagcgtcatgcccttgatcatatcaggtgatactgttttcggggttactgtggctttgatcccctcgcgtaactctttggtcccagtcagataaaaatttctggccgacgctgattcagcttgatatccggtcatgtattaaatagttagatcttggtgttaaaaataatgttcacgttcaataaaagttcctatcactttatcgtgcatttccgccgactttgaataaccgatggtttttctattcaaccttttgattcgggtacgatgcgttaagttcgttctctctatacgctgagtaaacgtctttccagtcaggcgctctttctcgggaaggctgtcataaacaacataatcatccgtgcaataaaaccgaatatcaaagggcgataagagggcaaggagcttgtctaacgtttttctactgcgatcgaaacatgggctagtattcgcttcagccggggttcccaagcataccaaagccagcgttgatttttcttgttccccacaaacgacccttgctcgtctatttcgcagataagctgaatgttctttccatcaaggggaagtgtcgttacatttcggggtctgagttttttaatgttttcatgacggttgctgtagcgactttcaggaggcgggcggtgtcacgaattcctccgttattcatcgcgatatcgataatctgctttttaacaccgggtttgcaggcttggtaggtgtattctaactgaaagaccttacagcagatatagcagcgataacgaggatgtccgccatttccttttccatgtcctttgaccgattctgattggtgacaataacggcaatagacgtcaactttagccatgcttcatccttaaaaagctggaagcatatcacagcaactaactatttaatacatgacccgccaatccattgaaccgcctcttttggaaattcaacccagcagagtgtcaatgcgccagaatgtctttggcacatagtacacgagcaggtgtgaggaaagtcggggattccggtagcaatgaacttgatattgccacataaacatccacctttatattctttctggctcatcattactccttacgcgatgttgtacttctgcttgtattatttttattcagacaaagaaaaatagcgaacttgtacctttattctgctcaatatataaagtactgcgtagaaatataggtattattttaatccgagtcgatttaagaggaaattatcatgcctgattaccgacttccttacactattactccggccatactcaatcgggtggttgaaatcggcgaattatgagggcgttggtcagcacaagcggagcattcttcgcctaatcaggaagtacgcaatgcgatattggcctatgaaaaattactgaactggcagagtcatcgattaactgaaatttgttttcctgatgcgaaaattaatgctaaatttctattcacgtttctcaggatgacttgacagcgggggggttggttggaaactagttgttggtctaatgtttttcactatgattagatttgctcttttgggcttcttattttccctcaagcaactgtacaattcagatagtttctgattggtaacattcatctagagaccctatacgaaaaaacccgcttcacgaaagcgggtttttttatcactacagcttaactgctcaggctattgccctcatcgctattgtaagctttagcgaacttatcggccgttaaagcgcgataacattggcagcagacgggcctttagcgccactctcaatggagaattccactttttgcccctcgtctaaggttttaaaatcgttaccttggatcgctgagaaatgtacgaatacatctttgctgccatcctccggagaaataaaaccaaaacctttaccagcatcaaaccattttactaaaccagtcattttattagacatagatatttcctttaattttgagccactttatgtggcgaacatggcctgttttgcagagatttacttattgggcacttaggaggaggctcatgaagaaggatatctatggataacgcttgaactgaggactgctttactaaaactgctttcataaggtctgtgttccaaaccgattgactataatagccacgtaatgatttatttagcaagaattaatttttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaagttttccatatgaaaggttaaaaccaccgactttagtcggtcagctttagctgcgatactgcgttgcacgagaggtgcaatatggattacatatatgacagccacacggtatttcagattgaatatcattttgtgtgggtaactaagtacagatacaaagtgttgacaggtgaagttgctctacgcgtgcgagagttagttcgtcagacatgtgaagcatttgaaatcaggatattagaaggtgtagtgagtcaagatcacgttcatatactggtgagtagtcccccaaccttggcgccctcagaaatcatgaggagattgaagggaaggacagcgaataagttgtttgaagagttttcgcatctgaaaaagcgctactggggtcgacatttttggggcagaggctatttttgtaccacggtgggccagttaacggaagaaatgataaagggttatctggcacatcattttgaaccgaatccggatgataagttcagaatggacaattgacgcatcgttcagccgatgcgtatccggactttcagtccgttaatcattaacccaccgactttagtaggtggttgttgagtaatattttctcgtctatttatcaccataccttctcggtgactgcatgcactggggcacggcgcttaccatggaggttgactttcaacagagtacccattcatcaaaattagtgttgcaaaaaaggggtgaccatcgatttttatgctcttcatatccagtagtagctggatagattgtctttaaaattgacataccatcaatcttttagtttactatttgtgatattgttacaccaagggtgaacctatgtcatcaaaattaaactggcttttgcaaaatactgcgccgggctctctggtgttgcaatcctggctgacaaaacacggtatcagtccctcgctagcgaataagtacatgcatagtaactggttacaaaaattacgaaccggggtgtacgtgcgggctgggcgtgatcctgagtggtgggatgtggtgttgtgcttgcaaaaccagcttggtttcccagtacatctggcggggcttaccagcttgggatatcaggggcgctctcattatcttcagttcaagcaacaagccatttggctctatgtgcaagataaagctgcgttgccaaagtggttcaaagaattccccaatatcgagtggcttttactttctaatcagaagctcgctaaacatgatgaaaaatacctgacagaggtagaaatcaagggggaacagctaagaacgagtgtgcctgagttggcagcttatgagattgccaatgctgtaccagggatactttcgtttgaacacgccgccgaactttttcaagggctagtgaatctgagcccccgtaaagtagaagcgctgttgcaatctagccgagcggtgcaaactaatcgtctttatctgtttctggctgattattatgctcatgcatgggctaagcgtttagatcaaaccaacattgatttaggagcagggaagcggcagattgtgtctggtggtaagttagataggaaataccaaatcaccgttcctgaaaaatttgtgagccatgggttattacatggataaatattcgccgtactaccgacaagttgcattactcataagcgcactccttgtggtggcatcggagcgctgttttgcgctaaagggtgggacggcaattaatctgtttgtgcgtgattttcctcgtttgtcggttgacattgatttggtctatgtaccactggaaagcagggacgtagctttggctaatgttcgggctgctttaacccgtatcactgggttgctccaacaacaagtgggtgtttcggcaatactgcaaacgaataaccatgatgagatgcgcattattgtctcttctcaagaggcacaaataaagattgaggtttcacccgtggcgcgtggaacgctatatccttcccaggatcttgatgttgctgaggcggtagaagacgagtttggttttgccactattcaggttgtctcaatggctgatctttatggtggcaaactgtgtgctgcattagaccgtcagcatccacgcgatctttatgacgttaaaatgttactcgaaacgcaagggatagatcgccacatatttaatggatttatcacctatctactgagtcatccccgaccgttgtccgaagtattgaatccccgttggaaagatatctcagagctttatgctcatgagtttagcggaatgacatttgataacgtatcgctggaagaactcaatgttgtacctgaatttatgatttctgccctcaagtcgcaattcactcagcaggattttgatttcctaatatccttcaaaagcggtgagccggattggcaacttgtccctgagagccaaattcagcatttacccgcagtaaaatggaagttacacaacattggccgtatacctgaagagaaacatattcaggcgctggagaaacttgagagagtactgaacgattggatgggatagtttataaatttatctatacctttattttaggtattactatgtggccgatagatatttatcactctataatgacctaagataaatatcagtaaaaaatcattaaggtatatacgcaattaacttgaagatgcaggacttaaagtctggaaattatctgttaaccgggtggtgagttctttcgctttttctggcaatgtgacatgaaaaaagtgatgcagcgtttcacggaatgtttttgcctccgagaaatagatattatttcgtacctgctcattcgcatacttccataatcgctcaatcgggttgaggttagggctgtaagggggcagataatgcaactcgatattcaggacctcggcaaaaaattgaactatttcagcgcggtggtaaccggctccatccagaatgagatgaattttttgtgaaagcggataggtttctcgaattgagccgaaaaacaggacaacatttttcgcgttaatcgtcggatattcacgaataatggtctcttcaatccgttgcaaattgagtgcgcccatgatgttaaggcgggtccggctgcctgtggtttcgaccactttgacatgctctcttccgcgcctcatccagccgtaacttaattttgtggactgggtaggatgcatcgcatcaataaacaaaataggcgcattttggccacattcagctttcaacgcgttgtaggtctcaataaagtgttgctgtttacccgcatcggatttatgaggcgttcccatcggcttcttgtagctgaacccttggcggtggagccattttgtcatcccagccacagtgaaagtcacctgccagcgcgcccagacacaagccacaatttgcgcggtagtgtgcatcaaatttgccgtcagatactccactaattctgtcgtttgttcggcagataaacggctttcagagccgccattttcaggggcgagtttttcctcagagacgtaatccttcagatggcgactcaccgtactttcatgaatacgcaaagcctgggcaatcatctgggcagtccagccttctgaggccaaaagcacggccttgatgcggtcacgtacacgcccatcacgagtcgtatcgtgcatcaattcgagggcttctttttgggcatctgtcagagtaattgtcatgggcgcgatcttgatctgatacgaataaaaaatcaagcatcttcaatgacgatgggtatatatagaaaatatacttaatcaattgataatagaatatgtttgcgaagctgctcgcacatattttgcaatgaatgcaagacttttgctacgttcttttagagaaacgagcaaaagtcggtaaaacactcactcaaacatcgataagtaacgatcccttgaccagcgataatataaggccagtctattattaatttcttctacatcaaatttctcaggggaaaaaacgttattaggggaaatatcagcttcgccattaacccattcaaacatgtcttgatagtcttcatgagtgggatctttaagaatactaagtagttccatatagccatataccccaccggaatcttctggtgggcaggcttgttcaccttcaaggcagaaaataggcatcggcaacttttcgggagaatagttactgttttccagtacaatctcatgctcccaatcatcaccaaaatcataaagataagcaaacttgcttcctttgcgtttgatgagcgaatccagtttgaatcttccttcttcctgacaatcactcattccatctggcatttcggtaaagcgtttggcgctaaaaatgaactcatgtaagtgactgtcttcccaacccatcacagcttgtatcacatcgtgcaaacgatccaatgaaatattggatggaacaacaaagcgacgccatataaccggctcggtttcagtaagcgtaatttttaactgatagaacttttccatttatcacctctatgagttgatgaattgacgggaaagagctaaatattcgcatatttccgttacgatatgaagtgatccggattaaaattcgaacgatttttatactgataaaattagctgtctgctatttagttgattttttagcaatttggttttgctaactctattggttatagatattgttattttgttaagttaactgtttttctgtcaataaattctctttgaaaaagagaatttattcctttgtgaaaaatatcatttttttcgcattgaagactgtagtaaaatcgagctaattttatcgtctggcaaaaatcaataagtgatcaatggtagtgtccgtgatttttgtcgggttttcattttcaacgacttctttttgttatcgttttatcctgaatgatctcgcaataaatggatagggtttggagtcaaaatgattgacgctagcaaaaatttatctacggctatctaaaatcacaggaaatttatgtctttttttgataaaaacaagaaggcatcttgttttgttgcgctattttttcttatttttcttatacatcaatgctttgggtatcaattgaagctgatatatgtcttcagtgcctttgccttattcttattgctggcggcggtcagtaagcgtgtatatctctttttgattacttttttttcccttgtggcaatactgtacgcgccggttggcctgaattacggttttccagatattaatgcggtaggctcactgctttacacaaaccagaatgaaacgttggaatatatcagtggatttcctgtttcaacttacttaaccgtgatgggtatttttgccttgatgatgttctcattcaggctaaatgtaaacttatcaggaaaaaataaaaaatggttattttttctgttcttcattcctgcattttggtcgccagccaaaggatatattaaatctggttttgaaaacggtacggagcttttgaataccagtttacctgaagtccgctttttcagtgatgcttaccagagttacactaaagtgatgtctgaaaatagccgtttcgccaaaattatcaaacttcaggatgattggcagcccgtagtcaaagaagaaaaatacgacacttatattatggtgattggtgaaagtgtccgaaaagattttttgggcgcttatggtttccccgataaaaatacaccgtggctggataatgcgaatgcaaccctgttaacccactatatttctgccgcaccatcaacccagctatcactgacgaattctctggcgatccgtcagtcgaatgggattaatttgaataacagtgttgtcacgctggcaaataaagcggggtttgaaacttactggctttctaatcaagggatgaagggagggtttgattctcctgtggcaatgatcggccaacaggctaaacattcgatgttcttgaaagaaggtagctccgatgacaggagctatatgccggatgaaaatttattaccttatatccgcaacgcactgaagaatgatcaacatgataaaaagaaaaaactggttgtcatccatttgatgggttcgcatccgcagccctgtgccagaaccaataaccagtacggtactgatttccattccaaaaatatctcatgctatgtacagagtatctataataccgatagcctgctggctgaaatagaaaacattgccaatcaaaaccagttgaactggacaatgctttattttgccgatcatggattgtcctttgtgcataaaggaacggataacgagaacttgactcatggcgatgaaaatcaacagaattatcaagttccttttattattacctctcatgactattctgctagaaataaaatagatgcccagcgcagcggcctgcatcttttgcccatgttatctctatggttaggaattgaagagcctcggctggtctcagagtgtgattggttttccaatcaaaaatgccagaatcaacatactgtcatttcatttgatggtaaacatatggactttaatcgcctgaataacgacgccattcattttggtttatgaacagtgaattaactcacaaaacgtcacccattgcacccgtacccgaaccactgattagaggattctgaccgtttaatacggtattcaaccgctggctcagatcctcctgatatcgtgggtgaaagtttcatatcatagtgcagtgtggcgaggagtatagcttccctctggctatcagatagctggtttataaagagggaagtgaaagattaaatcatgacttgctgttcgtcttaccttaaaaagggtgttttatgaacaataataaatttttaaaacatatcccctggatgatattggggataattggcgcattctgccttggggtcgttgcgctgcgtcggggagaacatgttagtgccttatggataatcgttgcttccgtggcggtttatcttgtggcttatcgatattacagcctttatatcgccactaaggtgatgaagctggatgcgacacgggcaacacctgcggtcgtcaataatgatggattgaactacgtaccgactaacaaaaatgtcctgtttggccatcactttgcggctattgcgggagcggggccattggtggggccggtattggcggcacaggtcggttatctgccggggacgttgtggctgctggcaggggttgtgcttgctggggcagtacaagattttatggtgctgttcatctcttcccgccgcaatggggcatcactgggtgaaatcattaaagaagaaatgggacaggttccggggacgattgccctgtttggttgcttcttgatcatgattatcattctggcggtgctggctctgatcgtcgtgaaagcactggcggaaagtccgtggggcgtatttaccgtttgctccactgtaccgattgcacttttcatggggatctacatgcgatatatccgtccggggcgtgtgggtgaagtctccgtgatcggggttctcatgctggttgctgtaatctggtttgggggggttgttgcggctgatccttactgggggcctgcactgacctttaaagataccaccatcacttacacactgattggatatgcgtttgtttccgcattactgccagtctggctgattttggctccacgtgattatctggctactttcctgaaaatcggggtgatcgtcggtcttgcgattgggatcgtgatcctgaatcctgatctgaaaatgccggccgtgacgcaattcgttgatggtaccggaccagtctggaaaggcacgctgttcccattcctgttcattaccattgcttgtggtgcggtatctggcttccatgcactgatcgcttccggtactacccctaaattgctggcaaacgaaaaagatgcccgttttattggttatggtgcgatgttgatggaatcgtttgttgcgatcatggcgctggttgctgcatccattatcgagccgggtttgtattttgccatgaatacgcctccggcggctttgggcattactatgcctgatctgcataatctgggaacggcagaagcgccgatgatcatggcatcactgcaagaggtgacagcccatgcagccgcgactgtaagctcatggggctttgttatttcacccgagcaaattctgcaaacggcgaaagacattggtgagccatctgtgttgaaccgtgccgggggagcaccaacattggcggtgggaattgcttacgtattccaccagattattccagcggcaaacatgggattctggtatcacttcggcattctgtttgaagcattgttcattctgactgcactggatgcaggtacgcgctccggtcgttttatgttgcaggatttactggggaactttgttccattcctgaaaaaaaccgattctctggttgccggcatcatcggtacagcgggctgtgtcggcttatggggctatctgctgtatcaaggtgtggttgatccattgggtggcgttaagagcctgtggccgctgtttgggatttcgaaccagatgctggcagcggctgcgctggtactgggaactgttgtgctgatcaaaatgaaacgcgccaagtacatctgggtgactgttattcctgcaatctggttgctgatctgtacgacatgggcactggggctgaaattattcagcgacgacccacgactggaaggtttcttcttcctggcgaaagaatataaacagcgtatcgctgaaggcggggcagaactgacagcccagcaaatcagtaatatgaatcacattgtcgtgaataactataccaatgcgggcttaagtatcctgttccttgtggtggtctatagcatcattatctatggcatcaaaaccgcgataaaagcgagcaaaaacccagcgcgtacagataacgaaacgccttatgttcctgttcctgaaggtggggtaaaagtttcttctacgcactgatatgatactcagactgatgccagccaagtaaggcttcatcggtaacggctatactgtaatagcgataccccgcataatcgcctttgtattatgtggggtatttttctttggagaacagtatgtttggtaatcttggcaaggcgggtaaatatttggggcaggctgcccgcatgttggtgggcgttcctgactatgacacttatgtccagcacatgaaggagaatcacccagataaaccttacatgacctatgaagagtttttccgtgagcgtcagaatgcgcgctatggtggtgatggcaaaggcggcatgcgctgctgttagtgttttagtgagcaaaagatcaaaagaaagaaaatcgttgtcagtgaaataggaaacgaaaatgaaacccatatcagtcacaattctggcaggttttttgggatcgggcaaaacgacgttattgcgtcacatcctcaatgccgaacatggttataaaattgccgtcatcgaaaatgagtttggtgaagtgcccattgaccatgaattaattggggatagggcaacccagattaagacattaagtaacggctgcatctgttgtagtcgctcaagtgagcttgaagatgccttgctggatttactggacggaattgacaaagggcagatcgatttcgaccgtctgattattgaatgtacaggtatggcagatcctggccctattacgcaaaccttcttttcccatgaaattctgtgccagcgttttttgctggatgggattatcacactggtggatgcaatgcatgctgatcagcagcttaatcgcttttctattgcgcagtcacaggtgggttatgccgatagaattttgctgacgaaaacagatgttgcccctgagcatgatgctctgcttgaacgtttacagcgaattaatgccaaggctcccatttataaagtggttcacggtgaggttgacttaagtttgctgtttgatatcgaaggtttcatgctaaatgataagctgacggtttcgaacccggtatttcggtttattcccaaacaacaaaacaccatccagtcgattgtcgttaacttgaagcattcggttgggttggccgaggtttctgacttaatggaagagttactgctgagttttgctgacaatctgctgcgttacaaaggtattcttgctattaaagaagagccacgccgattactgtttcagggagtacaacgcctatatagcgcagactgggatagagcttggcacgataatgaggaacgcctcagcgtgctggtttttatcggcatggatttacctgaacagaaaatccgtgaaaagtttgcggaattgtagttgattatattttattctttattgagcagtgaaatagtttgtataaaaatccgctgctcatatttaaatagaaatttatattatatatgcactcttttcgtcttggtttcttgtaaaaatataagtaatattttaacaaaaacaaaacaacaagaataaaacctattcataaattgaatttatcatatgtttaagacaattcattatttatgttatggaggcattatccatccgcaatctccacaagttagccggtggagattgttgcaataacagattatgttagtgaaaaatgggaatgataaataaaaggcttacttcgtatgctactcccaaattctggaaaaacgtttcacattactggcggtgtaaatcaccgtatgtgaaatattacgatgcccgagataatcttgaatcagacgtgtatcacggccaagatccgccagtgcgtagccgcaggcatgtcttaacatatgcggatgtggagaaacactgacagatgcctgtttcccatagcgctttagtaacccataaacttgctggcgtgaaatagggccggatttttgggaaagaaacacccacggcgcatcggcatcccgccatttctggcggacatcaagccattttttaagtgcttcaatttcttttggaatcagagggtgtgttgttgatagcccaccttttaaccgcctgatatgaataattgctgaatttaaatcgaggtcggataaacataaattacacaattcactaaccctaaacccgtgaataaaacacattaatagcatgcagtaatcccgttctgcatgacgtccttgttttgtttgttccaaaattgcgtctatttcgtatcgggttaaaaatttacgttgcttcatgacattatcattcctatgacatcagatagattaattataaatagcaaggtatttaaaccaatcgaataaaaccagccatcagtatttttaaacatgattagcaaaataccagattaatctaattggaaaacagtaaataaaaaaaatttgcagcttctattcgtcttatctttaatgaaaatattgattgtaattgtataaatacgtgttatgtaaccctggtgtacagaatgaggcaatcataagcataattccacaataaaaattgtttgattaaaattcgcgactaaaaatttagtctaatttcatttttagatttttattcttccaatgttccttttatgggtaatgaaattgtatttttactgcatttgatgaaaaaagtaaatgatttaactaaggcgttaaagtattagttattgggtgatcaaaaaaacacccgcatctcatttttgttagctggtttacaatattaaattttgtattttttattatatttggtttttaatgctattttttgtggggataatttaaaatcaacgtggtactcagatgctactaatagagagggatttagcactaaatgaaaagtaaagtccctaatttaggataaattagttttaatggttattatttttaattgaaattattaatttgctaattaaatgggattatttttttattctatatggctcgtgaaatttaataaaataggtgtggattataattaatgaaatatcatttcatcattataattatttcttgaattatgtactgtcgaatatcatttttttgacgctaaagaccttttaaaataaaggtctttagcgtgtttgcttattcaggcaacccttgccttatacaccataatttcgataatttgtgtatccgtttgttgcatcgcgtggtgagcgagtggacaaaactgatcgtaattcacctttctcacgttaagaaaaggctagaaaaggagaaatacataacaaaatcccggtgaagataattaggattagcgaggcgcctttgtaatgatggaggctgggtactttgtagaccagataagaggggatcaggcaaccgacgataccaaatattgggctacagatagaagtgaaacttaagactggagcattcaggataatggcaccccatgccaataagatggcaaaaatcataatgcctttttgcacccatttttcattgatcttttcagtgggcatcaggcgcccgagaatattcatggcaattccctggctggcttcgcgaaacccgagataaacaccaaagaaggcagtcattaccgcaaaaatattgagaataacactgaccgtaactacccagccgtcagggaagaattgtgcagcgatagccagcgcagaaatattctgttcataggctttgatggcttcatcgtgacccattgctaaagtaaaggagatggcatagaaaaatactgtacaaaacaggacgccaaacgccatattcatggctcggagcgctttatagcgcgcaacttcacgattttgctggcggttacggtaagaaatcaccattggacttagcgtctggataaacaggatggaagtgagtgtaaagggtaacgtgataatggcttttttgatcagtatggcgaaaggtggcagcacgccgatattgtacagatgccacatcccaatcattgaaagacccaaggcggcgacaacaaataattttgtcagcaccatcaggctggagattttgaacagccactgttctccacgggaggaaatcgccaccagaatacaaattaagatcagtccataaaacggatttttggataatagctcactggtaatcccaaatgtgtgcagataagaggcgctatcgttggtaatggcagtcgagtacacaaacatccagatcaccagcatgataaagtagagaatacctaacaaaatgccccagtttttgccgagatagccactgatcacgctgggataatctttacattctggtgattccgcgagggtattgatgaataatcgctgaaaaagatacatggcgggatagccaatgatggaagataacaggaaaacccacaatcccatcaaaccgacctgaacaggcaggaaaacaattccggcaccgattgccataccaatactcatgatggtccaacctgtgtcggtactgtcgaattttatggcttttttccattcaacttcagtcatattggcgcgcttggctgccggagaggtatgggtcgtgacctcattgttttttgttgctgttttcataatagctctcgcttacatctttggtgttgtaataggtattgaacaggtacagaaagaaacgcatcacataaacacaaaataaccattcattaagtaagtgaactatcgtgtgtggatattaaaggattttttttcaatgggagatagcaaaggaaaaccatacagaaaaagaacgcgggtttatttgtatcatcatgataaataaagttattatatcttcactataaggtattatgattatttgtgatattaacaattcaaacaattagagagaaaagttgtgtgctttatcacgtttgcacctactcaaaacaccctgtcagtattaaatcctttttattgttaatattatggggtagttcagcatattaatctagatttttttccggctatcccgtagacactaaggatgaaaaacaagcgaataaaatgcctgtcgtttgggctatttttctgttcgtgctcaaataacttgtaattttgagttctaaatggaatatcattcttcagtataattattcattttattaattactgatgttattattttagataatataatgatattaattttaatggttttattaaattgaaaattggaaatgtgttaaattttgtaagtcaatgaacatataaaagttataggttgtgtttcactgtaaatagaactttgttagaactgtcacattttaaaattaactccataaggtatgattgcattgtattataaataaatttatttttttgatttatgagatttttaattaaatgtaatttcacagatgaaatttgtgtcatagtgaaataatttttgtaacattatatatagagagttttaatgaaaattatcggaatttcaggtttattaccgtcacgatgcgtaactaatagtgatgtacttgatttaatagaacagaattcaaaagaaactttccagggtgatttgcccaaaacattaagaacgattcaaaggttactggataaaacaggacttgaaagcagatattggctgggtgaaggtgaaaaaccgatgcgtctgatgaaagaagcttttgaacaggctttgaaacaggcgaatatcagaaaatccgaaattgatctattgatttatcctaacgtcactcgtggtttcactgagcctgcaaacagtacttttattgcaaaggcgttaggattgaattgccggaattatgatgttcttgatgcctgtaatggttgggtaacggcaatggatatcattaatagtaaaatgaaggcgggtgaaatacgttatgcggctattattaatatggaatttggcatgtctgaaggcggtccattcagaaagaatttttctttgaattctgcttctgaattggcctataaatatcctagctttacaataggtgaagcggcttccgtaaccatattgagcaatgaagatacagataattttaaatttgattatatcagcagacccgatttaagtgacatatgtaatatctctttacctaattgggaattgttttgcaatgatagtgatgttgagcttatttcccctctgggaggtaaatatcagttcaactcatatgccgcagcactccatgaatatgcaggagaagaagtacccaaggtattcaaacagcataatatcgccagtagtgatatccataagattttcattcatacaggtgcaccaaatatgtgggatggctttggtaaagccgtcgatgccgctgacaaaatgcacaatatcggccagaaaaccggtaacattattaccgcttctattccttttggtatcgctgatgctcttgagaaagatcgggtcgaaagagataaactctgcatgggatgggcaggcagtggtggaatggtgttttccgcgatgtcgtttaaattataattaacctcttgtcttatttttttaactgctgactgaatatatccccttcgtcttttaagttgcagttttgttaactacgctcactctcctcgatcacataattaactatgtgaccggggattcgtttccttgccgtcgaaatcaactttatcaataccatgagtttattcgactcataagcattatgctcattgtctatttaaatagacttttcctataacaatatctattatttttccgttttattttagcggtatccgcctgtataagtaatctgacaggctcaattgaaaatttattcagattcaggaagacattataatgaaaagtaaattcactctggcttcactttgtttggcttctcttatgctgacaggatgtgcgacagaatcctcttcaactctccaggttcaaaaagtctcttcgtataacactatttatcaaggtatccgcagtcctatcgctgtgggtaaatttgaaaatcgctcaagctatcagaatggcattttctctgacggcattgatcgtttaggcaatcaatcaaaaacaacgctggtgacgcatttacagcagaccggccgcttcaatgtgttggagcgtaccaacatggcagaattgcaagcggaagcgggtttgcagggtaaagcccagaagctgaaaggggctaactatgtcattacgggtgctgtgaccgaatttggccgtaaggaagtgggtgaccatcaattatggggcattttgggacgtggtaaatcacaggttgcctatgcaaaagtgatgcttaatgttgttaatgttgaaacgtctgaagtcgtcttctcctcagcaggggcaggggaatataaattatccagccgtgaaattattggatttggcggtgcatccggttacgactcaactctgaatggcaaagtattggatttggcgattcgtgaagcagtcaacgaccttgtggcaggtattgaaaatggcgcatggaagccagttaactaattatatcgggaagatagtttaatgtttttgatgaaaaagaccttgatattgttaggggtattattgttggcgggatgtgtcaaagcgctgaagaccatttacgaatggggtgattaccagccaacagtttatcaatactatcagcaggacaaaatggggctacaggagcagattcaggcgttgcagaaggtgattgaattagccaaagcgaaagataagtctgttcctcctggcctgcatgctcaaatggggttgctttatagtcaaacaggcaaaattgatgaggcctttcagcagtttgccatagagaaaaatttattccctgaagcggcaccttatatggattttctgttgagcaaaagtaagggagtgaaataatgaaccgtttttggggcgctattgccgctttattattgctgacactgacaggatgtgttcaacaaaagccttatgattatacggctctaagggaaagtcagcctaaatccattctagtgctacccgcagtgaacaaatccgtggaaatacaagctggtggcagcctgatttctcaggtgacttacccactggctgaatctggatattacgttttcccggttgcggtggttgaagagacattccgacagaatggtgtgacagaagcgtaggatatccaaaatatcagctataagaagctgcatgacatttttggtgcagatgctgcgctttatctggatatcacgcaatacggtacacaatatctagttattagtagcgatactcgtgtcagcgcagcagcccgtttggttgatctacgcagtggtaagcaactgtggcgtggtacggcgacagcctcttcaacagaaaatgataatcactccagtggtgggctgataggaatgttagtctctgcggctatttctcaaatcgcgaatacgatcactgacagaggccatgatattgcaggtattaccagtaatcgcctgttaagcgcgggtcaatatggccgattactgtatgggccgcgttcggaacactacggtaaagaaaaattataatttttttgtgttattagcgtgaaaaatgccgcagatattctttgcggcattgtttattttttacctctatttcagatatcaaatatccaatcgcttggattgccatcttttggacttccagcgccaagcgttcacaagtcctcgcatccattcatcgcagaagaagccaatccagatccccagaatgcccatattcatcacgatccccagaaaatagccgacaggaatggagatacaccacatgaaaatcagtgcagtgtagagcgggaagcgggcatcaccggaagcgcgcagggcattgaccatcacaatattgaaggtgcgccctggctccagaaataccgataacaggaacagaggcagtagaagctcaataatctttttatcttccgtcatcatgttgaggagtggttcccggagcatccagaaaaccagtacgacaccagacgttacgataactccgattttcaggctatttaatccgcggatataggcatcttcgaagcgttttgcgcctacaaggtacccaaccataatttcattgccaatactgatggaaataccgaacaacataatgaacagcgataactggaaatacatagtttgtgcagccagagacgtttcacccatcagaccgataaatgcctgtgcggccatatattgcagtatccacaccagattttcaccggcagcaggcaaaccgatatgcagaattttgcccagcatatttttcgaccagtgtatgagcaatctggggttgaacttaatcttcaagccataaaacagtagcccgccgagtaaaataatcgcgacagtacggccaaacacggtagaccacgccacgccttccagcccatatttaggcaatccaaagaacccatacagaacaatcatattgccgacaatggtgagcaggttggcaatcagagtgacatacatggctgctttcgacttaccataaacccgcagacaggcagcgagaataatcgacatagcttctggaatcagacagatacccagaacacgcagataagcgcccccatcttccatcaggttttcgggcaaattcatgatgtgcaggatcttataaccgaagaaaaccgtgaccagcgcacaaccaagacccagtacgaaattgaaagcaatggagatatgaatggcttggctggctttatcccgttttcctgaaccaagatattgcgcgattacaacactgcaacccacactgatgaaattgaaaatcgtaatgcagagatcgaaaacaagattgcctccccccatggcagccaggtaagccgaagaaatatggctgaccatataggtattgattaataacgtcgccatgtgaagaaaaatatcaatgaagatcggccagctcagtgagaaaagcgaacgatcaacaacatcagattgatgcattgtaaaacctatcgattgaagtggaatgaatggtctttttacggtgtgacatacctagaaagtgtaggtaattctacaaggtttattggtcatttggtaggcgggttacgcgattggtacagatggcattgcgcttccatgacttgctcgcgaatttctacttttggccgcccctgcattttcagcccataaccgatgttttcgcccaaagacatatgaggaaaaagtgcataagactggaatcttgttcacctctgcttttcagatatcaattatatgattgattttattgattctaatatcatcattaccccaaggataatgagaataagaccgggaatacgcccgagaataaaattggttttctctggggatatccgtttgagttgggctgtgataaggcaatataaaatattaaaaaaagtggcgcctatacagaatatggtgccgagaacaagtaagagataatcggggctgttttgatgaacaaattgaggaaaaaaagagacaaaaaatatgcctactttaggattgaggatactgatcaataacccgttaaggagataggaactggatttttttctgtttatgttacggtcatttttttctgacgatgcagtaatttcagatggcttagagcgatagatattatatcccatccaaattagataaagcgcgcctgctgtctgtattatggtatacagagccggaagagacatcagtatggaggttatcccagcccaagtaataaaaacatagaagtaatagccaattgccagccctatagctgatgacgcagccgctttccagccgattcgatgataattactcgtaacatatatcacatccgcaccaggaatagcattaatagtaagagccgttacgagaaaaagtatccagttcacatccagcatactttaaattcctttcattttgagaaaacaatattctgattgacgctttactttatccgtaaaagttttgctagtaaagagagggctgtcagtgccatattcaaccgatagagtatcaataaaattaaatggtttgcttctttccaagtagtctttcatcagctcaaatgcgagtaggtaagattccccttttactgcccatattgtttctaacgaccagagtgaaagtagttttttccgctctataatagcccccgtgtctatccctgtgtcaacatagtgtagtgttgcaccggctgcacgctcgactgcatctttatttcctgttgcagtcagttgttctattgcgtacatgcctctggcatagggaagaacggcagaatgagcgttaacgatctttttttcaaagtgattaagccagaatggagccaagataacatcaaggaaaataagagcaccatcattatatttactacattcattattcagataatcttgaaaaaaatttattcccagtttttctgtatcaatgatattagcggaagataaagcatgagtttctgggacgccataattttttgcgagatatttttctggttcactgaggcctttataagatatttctaacttgttaatatccccatctgttattttatccttttttgaaagttcataatgtatattgttgagtgttgatatatctagttttctggcatttctgatcatccaatttagctggaaatgactcagttttttatggagaaaactagtgtgaaaaaaagtttcagttataacagtaaacattttttatcctattattataaaaagtaactggtttttaaatggaggaggtttacaatggttttatttttagtcagactatagtttatttttgttatgaaataaagttgactatttatagttttaaacctatttccttattgttatgtgttattttttattggggttttttatctgtatttaatgatttaattactatttttagtcatgataaaggagattaatatgctcttcgatgacatatcatctttaattaatgacagatgttttataaatattaatggttggattcctgattccgctgtttcattaaaagtggaggggatttctgttacaggatcaataaaaataaagcctgcgctatatatgatttcagcgcttgaggatagtggggtactaagaacaggaaaaaaattgattgagagttcgtcaggaaatctagggttagcattgagtatgatttgtgcctggaaaggttatccatttatttgtgttagtgatccgaatatagctcctctgactgagaggacgatccgggcatatggaacaaaccttattatagcgaaaagtaaagataataatggaggttatttgggagaaaggataagaataattgaatctatgctaaaagaggatcagaatttaatatggattaatcagtatgaaaataaaaataatgttctttctcattatagtatgacaggaaaaagtatattggagaaatatccatatcctgattatgtatttattggcgcgggaacgacaggaactcttggcggtgtgtcaaactatatacgtaaatactctccttcaacgaaaattattgctgttgatacaaagggatctgtcacttttggtggtgaaccaagtaaaaggaggatccctggcttgggaaccagtaaggcaccagaaattaaaaaatattcacaattcgatgagattatttacatagatgaaaaagaaaccgtattcacttgcagagaattggcttcaatgggcctccttttaggaggatcaacagggacggttttagctgctgtccggcattatgaaagcatcattgggaaaaacaaaattgttgtggctatttctcctgacatgggagagaaatatatagacactatatataatgatgattgggttaataaattttataattaaggaaataaaatgactgataataaattcactattatttctggtaatgatgttgaagtctggataaaagagaataaggaaaagattatcgaaataattaaaaaaacttattgtttatttagcgatggaatggtaactaatcctgatagtcatttcttgagatttcctgatagtgacaaaaataggataattgctctacctgcatctatagagcatggtaataaagtagccggaatcaaatgggtcagtagttttccagataatatacagcatggattaaaccgagcttctgctgttgttattcttaatgatcgtaatactggctaccctatcgcttgtattgaaggtagtcaaattagctcagcaagaaccgctacatccgctatcattggtgcggagtatcttcatcaggaaaagagatgtgatcaattggctgtcatagggacagggttgatctctttttctatcgttgaatatttatatagcacaggctggaaaatcgagaatattgttgttagtgatttatctgaaactaatgctgccaaatttatctcatactgtaaacagaagttaggtattgaggctaaatatttggatacgactgatgcgattagtcaatcagatttgattatctttgctacttcggctgttagcccccatatcgttgatcccgcgctgttctcccataatccaaccgttttacatatttctctacgtgatctttctactgatatcatattaaaagcagaaaactatgttgatgatatttctcatgcagttaaagctcatacttctctgcaccttacagcagaagagactcgtgatacaaaatttataaaaggaagtatatctgatcttattcggggtaaagttaaacccgacaaaactaagttaagaatatattctccttttggaatgggaatgctggatattgccgtagctgaaaatatatattctgatttgaaggatatatcaggcattacaatttcagactttcatcctttacccgtcatgagataaatatatttttattgcatggtaaaacgatcaagttattaatatggcaataacttgattaatggaataacttaagaaagttattttttctatatacgatatatgataagtaatagataggatttttccaatttgcatgtaatcatacaagcatcaaaagaaggctatccagatgaaagcacttatcgtaatcgacatgctgaatgattttgtaaccggtgtcctcgccaatgaagaaagtgcgatgaaaattactccgcctattcagcgaatgatcaaacatgccagaaataaccctgattggttggtggtctatgtcaatgatgcccatcatgcggatgatcgggaaatggatatctggggaaaacatgcaatggtcggtacatggggtgcggatgtgattgatgaattggctccaatcggcatggagcgtgaaatcgtttttcccaagcgattttataatgcgtttgacgggacggatctggaaaatgttttcgcacaatatggcgtgactgaagtggtgctggtaggtcagcatactcattgctgtgtccgccatactgcttacggtgcgtttactcgtggttatgctattacggtattgtccgatgctgtttgtgtttcccccggtatcgatcagcaagctgcccttgattatctgaaaaccatctatggggctgaaattacgaccagcaaagcattcggagtatgacctgagtgaaagatgaatattttgtcgggtaaatggaatatataactggcagattaattatctgccagtgaaattattttacataagctagcaggctgagagagggtcgggcaagcgcctggcattttgccttttggggcagattgattcccttcagatcgttgtagcctgactgattcagttcttccattaactgactgttgtagttattgagatcccatttgttgcgttgagcaaaataaataactgcacgcctgatctcacgatctgggatttggctatagccacaatcatatttcaaataaatgtagacggctgtcatatcagcaagactttcagcctcttcctcagacagagcttttgcgggttgcgcgaaactgaacagaaccagaatgtaagtgagtaaagcaatcttttgcataatttctattatactgattttctactgttttacctaaactaacatattaatatctttgttagccaaactttattttcttaactttaggaaaattgccattttttctgtggcgtactgacgctgcgaacacatgggttaaggggaaagtgactcttgttattgacgatcatcataacggtaacgggcattgccaccagtgtgatgaaccaagatatggtgatggtttggatttagtggcaagaactaaagtgatctccatcactgaggcggcaaaagtcgttgctgatgtgctggcgttgcctttgccagaacccaagtcaaccagacaaaccagagaagacaagcatatcgcgtcagcatggttttaatctgttgtattacgtgaaatttaaaataggtaataatctgattttgattgaaaaatgacatttatcacatttttattgaatgatttttgttcatagtggaattattaaatttttctggtatagcatggcgctcataaattgttctatcagtaaaattgtatcagcatagggagaaaggaatatggttataggacatttcttgactgtaggggataaaacaagctgtggaggaataatccttacaggaaccagtaacattacattttatgggagggatgctgcgatagaaggctcttttgttacctgtggaaaacattcaggcaacttttcgatcgtgggcggtgtgaattgcttttttgatatggaagctaaattggctgggacgttggatagtcagagcacttgtccttgtagggcaaatcttattaactccattcctgatagttatcaaaatgaagcacacttttctaattttacttctcaagatgttactaaagatacagaatcaacaactgctcagagcagtcacaatacaacaaataaatctagttctgattcatatgcacaatcagaacaaaaaattaagccggaaccattaccactacctgctgtaatctttaaaacaaaaaggaaaatggatgattatgatgctgaagacatgatatatgctgatttatcagaagaacagcttaaacataaagttgggctaactgatgttggcgtgccttgtcataattattcattgattgattttattgcacaagcagaacttcctaaagaaaatattatgcaatggtgtaacccatatacaatggaagatcgggataccagtgccagaatgttatttgataaattcagagaactatctgatttatattcatttgtaggtgaatatcagggggtaatgagaaaaatgatttctcatatgcaaggaaatactggggaaaagttcactgatccattacttgataaggcaatgtcagagcgtattttggaagatacatcagatcagagttctctacttgtaattaaaagaacacttattaaaaatattgattgggataatggttattatccattagataaaaaaggaaaactttatgaagcaataattggctctgtattaccaaagtttgacaatatagaggatagagttaatgggctgggaatcaccgttcatgacacgtgggcaacacatattactttgcagtctttggaagtaaatggtaatgctttcaaagctactatccattatcatatacaggatcactttggattagataaaagtgatgttacacattatttctacaaaaaatttcgtatattcaggatatggtttttacttcagcattggaaccaatatggctataaaccatttattaccgaaatgaatgtaacacaggtaatagaagggagttgcaatgaataagtataaattatttttatcactaatagtcatttttgttgtttatggagtatggtggctattacaacctgtagaaattattggtgttcatcatagatctagtggttacaatgatgttcttgttaaacattttccaataacagatcgggggaagattgattggtgggaaaaaaataaatcaatgcttaaaaataaatatggtatccctgttacagataaagacggtaattttgatataagtatttgggatataggtgatggatataaagaaatgcctaacactgaccaaaactcagatttactttgttttgatgatatgaaagttaaagcgaattgtattgaaaaaaatagagttctggaagtgtcgcgttttgacggtggaaagataagctttgtaatgagacatagtgcatatctacaacgcaaagaaggcggagaaattaatccatatcaatggtgaattgttacagttgtatctactttagataaagaaatagaggaatttccccgttgggcaatatactgacagatatagatttgtgtgaagcgttatcctatgtctttgtagataatgaagttgattatgaatatatcgcttctgtagccaaacatttcccgcttgagcatgtggaaatggtcttcttcgagtgggtggctccgatatgttataccaatgggcttatccttgtgcctcctgtatggactttttttgatcgtgaacaactttgggaagatgttcacgagctaaggcgaaaacaaataacaggaggtaagatagaaaaaataaaagaaaatatcaggcgatgttttttgcgtaagtaccttgaaaaagagtggcaacgtttgaagaaaaaattaactgacgatattttttggagataaattgaatactaaattagcatcaataataatccatatccaattcattcccataaaaaactatcatctgtttcttcatgtttttgtagaagataatttatattatttatttctttttgtaggcggaattttgccatttttcctagtgtgattaaagcgggttctatgttatgaaatttaattgtgaaatgaataaaattcacaagattgagcataaaggcataagacaccacgccaccaatcactttttagataatgaatgatttttattgatctattctggattaattctaaagatgctaaatgttcttgatatcttaaatggtcaaaagaaaaagtctcagccatttaaaagccaagcatgtagaacattacgttgattcccgttgatctctgggggttgctaaacggactatgcagaatgaaatgtccgcgctgcgtaatattttccgcatggcaggctgggagaaattggaaacctctccgcgtttgagcaatcaggtattgggattgagtggagccagtcgcgccggaatgaaacaggcgatccctgatgcaacgtctcaggttgtatatcagaaggcacttgaacgtgatgcaggatttgcagtcacactgaaacttgcccgtttgatgggctacgttctcaagaagcggtgcagtgcttcgttaaaaagctggcggaaacagctagagcaaccagagccaaaacttcatgttgttttcggcacaaaaggcggtagaccaaggcaaactcgtgtactggatgttgctgcggtgaaagaagctgtagagcaggcaattgccattgcagagcagcgaggcggcaagttgattgataagtcggatctcaagcaagccatgacctactggcgagtacataccacaaggattggtttaaatggaaggggtagcaggaatgattgacgttagaaatgactggcattctgccgatattatcgctgcattacgtaagcgtggtacgaccttggcggctatctcccgtgacgcgggattcaactcatctacattagcgaatacgctgtcatgcccgtggcctaagggtgaatggattattgctaattatctcgacactcacctgtctgaaatctggtctagccgttattttgatatgaacggtaatcttatcgaacgcaaaattcgcgataaatcatcaaaataattattctaataccggaaaatatcagggaaatagtcacattatctaattatctacggtgttatttgttttgatgagatggcacaattggttatccgtcaccgcaatctttaataccttccgacgaaatgcgtcgcaacctcctatcacaaggccagaacgtttagtgtactgatctactcactggcaacgatatttgtaggtagtcatagattcaacccttcttttactgtaggcggtgaattctgatatgctttgcaaaatattttgttctcatgttttttgtgtgtgcgtctttgtgtggtgaacggtatatcaatcggtgtatcacttttcgtaaaaagacacatgattttattttaatttttgtttaaaaatatatagttatgagtaaaccaaaacatattgtagaagtgatgatctccgaacaagagattaaacaacgtattgctgaattggggcaacagattacagaacactatcgcaatagcggccgtgaactggtgctggttggtttgttgagggggtcatttatattcatggcagacctgtgccgtgaagttcaggttccccacgaagtggattttatgactgcgtccagctatggcaatgagatgaactctacccgcgatgtgaaaatccttaaggatttggatgaagatattcgtggcaaagatgtgttgatcgttgaagatattatcgactcaggcaatacactgaataagatccgtgagatttttgcgctccgtgaaccgaactctctggcgatctgtacgttgctgaataaaccctcccgccgtgaagtcgatgtgccggttgagtggattggctattcgattgaagataaattcgtggttggttatggcattgattatgcccagcattaccgccacttgccttacattgggcatgttactctgctggaagagtaaattcctgcggtaaaccgtatagggaactatgagtaaatggcagccttatgctgccatttgtttttatgtggatctgttatttcttatgcgccagcttggaaatggcctgacggtaattaagttccagtttttcacggctgtcagcggtaacatccaggtcatgtagttcgccatctttcaagccatatacccagccatggatcatgactttctgcccacgtttccacgctgcttgcataatagtcgagtggccgagattataaacctgctcaatgacattcaactcacataaacgattcagtcgatcgttaggcggcaactcgccgagcatggagctgtgtttgtaccacaaatcccgaatgtggagcagccagttattgattaagcctaattcagtgccatctacggcagcttctatgcctccgcagccgtagtgaccacagatgataatgtgctcaacctgtagcacatcaacggcgtactgaacaacagataaacagtttaaatcagtatggataaccagattagcgacgttccggtgaacaaaaagatcgcccggtgcagcgtcaatcagtttttcagcaggcacgcggctatcagaacaacctatccacagaaaatggggtttttgtacttttgacaattctttgaagaagtgaggattttcttcgtttacggattgtgaccactgcttgttcctggcaaacaattcttcaatttttctcatcataactaatagcctggcaacgtttttgagatagaatcatatacaacattaattgagaatttaataattaattgaataatgttttttagttaatccctatcgttgcaaagaaagataggaaaaataatgtcataatttctatcttgcactcaaaaatagcaaagaataaaggtgttttttacttatggcttatgcattggagttgacgcagcttacgaaaacctatgcaggtggaatgaaggcgttgcgtgggattgatttacgtgtcgaagaaggcgatttttacgcattgttgggacccaatggtgcagggaaatcgaccactattggtatcattagttctttagttaataagagtagcggtaaggtcaaggtgtttggttacgatatcgacacggatctcgtcaatgccaaacggcaactggggcttgttccgcaggagtttaatttcaacccatttgaaaccgtgattcagattgtactgaatcaggcgggatattacggcgtaccccgcaatgtggcatataacagagcagaaacctatctgacccaactggatctatggggaaaacgtaacgaacgggcaaatcggctgtcaggagggatgaagcgtcgtctgatgattgtccgtgctctgatgcaccagccgaagttgctgatccttgatgagccgacggcgggagtcgatattgaactgcgtcgctccatgtgggagtttctgaaggccttaaatgcgcagggaaccaccatcatcttgaccactcactatctggaagaggctgaaatgctttgccgtaacatcggcattattcagcatggtgagttggtggaaaataccagtatgaaagatctactcagccaattagaatgtgaaacatttttgttcgacttcatgcccagaggtgcgatgcctgtcgttgaaggttatgactatcgtctggtcgatgcggcaacgctggaagtggatgtcaagcgtggtcggggattgaatgatattttttcccaactgagtatgcagggtattcaaatcagcagtatgcgtaacaaagcgaatcgtctggaagagctgtttgttgggttgaccaataataatcaaggagctagtcaatgattcaattgtactgggtagcgctaaaaaccctctggatgaaagaaataacccgctttggtcgtatttgggtacagaccttactgccaccggtgattacgatgtccctctatttcgtcatattcggcaatctggttggttcccgtattggtgagatgggagggttcagttacatgcaattcattgttccagggctgattatgatgtctgtgatcaccaactcatatgctaacgtttcctcctccttctttggcgctaaatttcaggggagcattgaagaagtgctggtcgctcccgtgccaactcatatcattattgctggatttgttggcggtggggttacccgtggagtgtgcgttggtattttggtgacactggtttcccaattattcgtacctgtgcagatccattcatggagtatggtggtgatcaccttgctggcaacatccatattgttttcgttggcagggttattgaatgccatttatgcgaaaacgttcgatgacatcagcatcatcccgacttttgttctgacgcctttgacttatttgggcggcgtattctattccctgaccctgctgcctgaattctggcagatagtatccaagctcaacccgatcgtttacatgatcagcggcttccgctacggttttcttggtattactgatgtttctctgacgatgacgttaggtatgctgggtatgtttatctttgttttttatctgttggcttggtatttgatcgagtcagggcgagggctgagaacctaaaaacaagaatttgtaaatataacgctccgccgttgtttacggcggagtggcgcaatagtgagtcggtcattggtgggaacggttatgcaacctgaacgggaaccgcttttgccagccgactcatcacattatcaccgtcaaaataagctactttgggtctatgaaatctagtcagctcatcagcaatttggacatatgaacaaataatcagcttatcgcctaccgccgcacgacgtgcagcagcaccgttgacggagatgattctggaaccacgttcagcggcaattgcataagttgagaatcgttctccattatcaacgttataaatatcaatcgcttcatattccagaatgccggctgcatccataaaatcctgatcgatggcacaggaaccttcgtaatgaagatcggcctgcgtcacttttactcgatgtagtttcccctgtagcatggtgcgtaacatgtttgttgctcctaaattgatgatgccgtacctgcggaagaaaggcaggacacggaaggagtgactatatcaggttgttaaaaaaacaccaaaatgcaattttaaaatattatttctatatatctaaggcgatatttttgtatgcatttgaataatgggtataatttgaatgtcaaaaccaaaaaatatcatgattatttccaaaatttgaagtagttcacataattttgaattttcgacaatattgttaattagaatttgacttaaataagttatggattttatttataatccaagcaattcattaatagtgaacttgtttgttatatttatttctcaataaaaatataaataaactaatcagagaaatattatgttgcatggatgtaagaaaaaataacttgttgtctttatttcttttgtatcaataatatgggtttatttgaacttgctgacagattttgagtataaatatctatatgcgttcttttcaatgatatttgcgcctaaatcagggatatgtgcatcacgttacgactccactaacacacacatcccatcactaaaatcagccaaccaaatcgacttgttgattgtcaattaagcgtactcgtcctaaccaggctgccattaggatcacggcttttttactttgcgatgtcagaggtaacaagttttctgcatcacggataaataattcatccggcataaagccttcttcacgcaaatgtgtcgatgccagttcgagcagttgttcggtcgctcgttctccatgcgtcagcttttctgcaatacactgcatgatctgatgcaataccggagcaatttttttctcttcagccgataagagattattgcgggaactcagtgccaacccacttttttcacggacgatggggacggaaaccaaagtaatatcgtaagccatatcagcaatcatcttgcggataatctgcacttgctggaaatctttttctccgaaataaacgagatcgggttgaatcagattgaacagtttgctgacaacggtggtgacaccacggaaatgccccggacggttagcaccttcaagcagataagaaagctctggtacttcgacgaaagtctggctgctgttagagccattcggatacatttcatttgcgttgggagcaaagaccagttcgaccttgcgatggctcagtttttcgcagtcttcctgtagggttcgcggataattgaccaaatcatcttcatgctcaaactgcatgggattgacaaaaatactgacgataactacgtcagcctgtgctttggcggtgtccaccaatgacatatggccatcatgcagattacccatagttggcacaaaggcaatacgtttgcctgcctgatgccagcggcggatttcacggcgtaaaatggggatcgtttctataatcagcattgttctactcctttaattggccgtcatgccggggaataattatttgaatgagtgtgcttggccgggataggcaccactttctacctgctcgatatacaggcggatggcatcccgtatgttgccggtttctttgaggaaatctttggcaaatttaggtggtctggcggtgatgcctaaggcatcgtgcatgaccagaatctgaccgtcagtgagattgcccgcgccaatgccaatgaccggaatttccagcgcttcgctcactcgctggcctaatgctgtcggcacacactccagcaccagtagctgtatacctgccttttccaaagccatcgcatcgttaagcaattgttgggcggaggtttcatcacgaccctgcactttatagccaccgaaaatattgaccgattgcggcgtcagccccaaatgaccacacactggcacggcacgttcggtcagcatttttaccgtctcacacagccagcttccgccttcaatttttatcatgttagccccggaacgcatcaatgtcgcagcactgctaaaactctgctctggagtggcgtaactcatgaaaggcatgtctgagatcagaaaagagtggggcgcgccagcacggacgcagcgggtgtggtaagcaatatcttcaaccgtgacaggtaaggtcgagtcaaatccttgtaaagtcatgccgagtgaatcgccgataagcatgacgttgatgccttgttcggcgaaaaggtgagcaaaactggcatcgtaagctgtgattgtagcgaacttgcgcttctctttttttaactgactcagatcagccagggttgttggtttcattgttatctcctgaatagttagggcctgtcccattgagcatcacttttgaacctcaatgggacaggccctgattatccaaaaatcggccacggctgtatgagatattgaataacttttccttcataaaacggctatgttacaacgataaatcctgctatccgtgctacaaccaaaacgtcaggccattttctggaacatgttttaatcgtgctgccagtgtttctccatctgggaatacaagattcggcgcaatttctgcaagcggataaagcataaactcgcgctgttttaagccgtaatggggaacggtcaggcgttcagtcttaataatgcaatcaccaaacagcatgatatccagatcgagtgttctcggcccccagcgctcatcttttcggatacgcccttgtgccagctcaatagcttgagtgtgatcgagcaacgcttctggttgcagcttggtttccagtgcaacagcaaggttgaggtaatcaggctgatcttgtggccccatcggtttgctgcgataaaaagaggatcgcattacaaagcttgtgtcagggatcacatgcagggcagcaagtgcattatcgacttgctgcaagggatcagccagattactgccaatggcgatgtaaacccgtgccatgtcacccgttgtccttgaactgacgaggccggctgctacggcggggacgtgttctgcgacgaacggggtcggtgcccagttctgatatcatgccacgctgttgaggtgctgtcgcctgttggaattctgaccaccacagtaccagctctttcagttcatgccgtggttcaacgttggcgcgtaattccaataaatcatacgcagcacggaacttcggatgctccatcagcttattcgcgcgttttccctgacggcgtggcagacgaagctgcaataaccaaatgtcacgcatagtcgtggtatgacgcttcggaatggcaatagaaccgcactgctcatcaagaatgtcattcatcgcgagagcaaaggcatcgtaatacggtaaaccaccttcctgagacagtttctctgcatgttcaatcaacggataccacaacatggccgcgaataagaaggccggattgacacgtttgtcgttctggagccgataatcggtatttttcagcacctgttccagcagtttttccagcggtgagtcattgtttggagtgaaaccgcgctgcatcatcgggaatagcagttggaacagattgtactcgcgcagcagtttataggtgctgtaaccatgccccgactgtaatagtttcagggattcttcgaacaagcgtgcggagggaatatccttcaacagaaaggcaagctgcgggatcggttcggcagtggttttctcgatggtcatgtcaagtttgctggcaaaacggactgcgcgcagcatacggacaggatcttcacggtaacgggtttctggatcaccaatcaggcgaatgatccctgcttgcaggtcagccattccgccgacgtaatcccgcaaggcgaaatcttcaatgccataatagaggctattgatggtgaaatcgcggcgaacggcatcttcttcgaccgaaccgaagatattatcgcgcagtaacattccgctttgtgctttttgtgactgattccggtcattggattcaacttgctcgtgtgacccacggaaagtggcgacttcaatcacatctggcccaaacataatatgggcaaggcggaaacggcgacccacaagccgacagttacggaagagtttgcgtacctgttctggtgtggcattcgttgcgatgtcgaaatctttgggttttttgtgcagcaataaatcacgaacaccaccaccgaccagataggcttgaaaacctgatttattcaggcgatacaaaaccttcagggcattgtcactgatgtctttacgtgaaattgggtgctgatcccgagggagcaccgtgatcggggggtccgaaggcttggcctttgcggattttttcttcattgtggcgttatcagcatttgatgaagatgagtgatgttctctgcgatgtttaggcagagtgctgctctctatttgagcagtatggtcagatatggtgactggcctttcactggctgcctgtgtgtcgcgttttgttttgttttcgcggatcatcaaattgcggcagaaagttgctactcggttaaaaatggtacacctcgatagtgactaagtaatattaaagcaaaaaaacagccgctaatcataacttactgggcattctttgagaatgcttgcagagccaatagaaacactttatttgaattggcgataggttatgtttttctgcggaacagggtttatattccaaccgacgatagcttgccgcagcacctgatctgtcgtgagatcttgccagcctgcaatggtgggttggtttaaaaatgataacgcatcaataagcaatggccgtggatcatccagtgggatcggctgggcatggttttgcttagagagcttatttccctcttgattgagaacgaggggtaaatgcacataatctgggatcgcaaaattcaggtgctggtacagtgatagctggcgaaccgtgggttcaatcaaatccgctcctctgacaatttcagtcacgccttgatggttatcatcaacaacaacgacgagattataagcgaataaaccgtctttgcgataaatggtgaagtcttcttccgccattttagcaggaacagtgatgtaaccctgcaatttatcgtgaaacctataaattggatggcgttgtttcaagcgaacggcggcattgtcagcaggcaaatatgaatgccggcaatgatcgtcataaaacccgcccaattgttgaatgcgctggcgggtacaggtgcagtaatagctgcttccctgttgttgcaactgagcgagtattgcacgataggcttcatggcgctgggattgatacagcacctcgccatcccagcaaagaccataatgctcaagggattgcaatatccggctggcggctccgggaacttctcttgggggatctatgtcatcaatgcgcatcagccatttgccatggcaggcatgcgcctgtaggtaactgcccagtgcagttactagggaaccgaagtggagatccccggaaggggacggagcgaaacgcccgatatataatgcggaatgttcagattgagtcatatcaggataaatataagggagcatacggcgccattcagcgccgtactcagccctaccggtcagccagccatttgcttttcgcgaatttcggccaacgttttacagtcaatgcataagtcagctgtcgggcgagcttctaaacggcggatgccgatttcaaccccacaggattcacaatagccgaaatcgtcatcttcgacttttttcagcgttttttcgatctttttgatcaacttacgttcacgatcccgattacgtagttcaagactgaattcttcttcttgcgccgcacggtcaactggatcagggaagttcgctgcctcatcttgcatatgagatacagtacggtctacttcatccctgagttgattgcgccatgcttccagaatcagcttgaaatgcgttaactgggcatcgttcatgtattcttcgcctggcttttcttggtaagcttctaccccagcgatggcgagaatgcttaaggacgaggttttgcgtttttgcccttcttgcataatgcttctccttacacacgcactatcaaacgacccccccaacaatggggggaaaaaaataggccgctataaatagcagatgactgcgaggttggcaattgttcctgccattagttttgcaatggtgtgaaggctaccgtgtttactgcctaaatatgttgcaaaacttgcctcatcagtatgttctgtttacaaattatcctattgatacaaaaggtaatttgtgacttagaaccatcctgtcttctgttatgctggccccgtaacagattacttcgacccctgaattacaggcttgttccaaaagacatgcataatcatggtcaatatgttttgctgccgcaacctgactaatcccagaatgtaaaacagcaaagaacagaacagcacgctgcccctgttgtgctatcaatgatagctcacgtaaatgtttttgccctcgaattgtcactgtgtccggaaaataacccttattttcctgcaacaatgttaccgatttgacttcaatatagcagttaactctctgttttgactgtaacaataaatctatccgactcttctcttttccatagaccacttcacggcggatttgctcatagtcagataattctgaaattgcatttttttcaatggattgatagaccaattcgttggctctgagtgtattgacacaaatcaaatgcccgttttgggtctgagtcagttcccagctattcggatatttacgtttgggattgtctgatgtggaataccacacggtatctcccggcatcgcgcatcctgtcattgctccggtattagcacagtgtatggtcagcgtttcaccttctggggtgaggacatcggcaagaaagcgcttatagcgacggattagggtcgctgacttcaggggaggcgaaaattccataaattttccttcatcgctaatggtcggaaagatcaatgaactgaaattaaagtagccaatgctacaatgacgcccattgaaagttaatggttagggtgatcctttgttattaccaatttatgacgttttggactctgttataactaagttgaaaacgtcgaaacaggtattgttgcatgcacccacaggggcagggaaatcgacaggattgccattggcgatcctgaataaagctcaactgacagagcgcattattatgctggaacctcggcgccttgcagcgcgcagtgtagcagagcgtcttgccgaacaattgaatgagcctgttggcgtgacggtaggttatcggatgagggcggaaaccaaagtcagtgcctctacacgccttgaagttgtcactgagggtattttgacccgaatgctacaacaagatcctgaattaagcgatgtttctctggttattctcgatgaattccatgagcggagtttacaggctgatctcgcgttggcgctgctgctggatgtacaggaaggtctgcgtgaagatctgcgtattctggtgatgtccgcgacactagacaatcagcgtctttcttctttattacctgatgcgcccgtgattgtttcagaaggtcgtagctatccggtagcacgatcttatcatccgctgccgattcatcagcattttgaacaatccgtagcttcggcagtgttgcgcttattgcagcaggaaacgggatcattgttactgtttctgcccggtgtgggtgaaatccagcgtgtgttggctcaacttgaacaaaaaatcaatgacgataccttattgtgtccactgtacggtgcgttgtcgttatccgatcaacggaaggcgatagctcccgtgccagcaggaatgcgcaaggtcgtgctggccaccaatattgcggaaaccagcctgacgattgaaggtatccggttggtggtggatagcggccttgaacgtaccagccgctttgagccgaagagtggcctgacccgattgatgacccaacgcatcagccaagcgtcaatggtacaacgggctgggcgggcaggaaggctggaagaaggtgtctgctggcatttattcagtcgcgagcaggcggaacgagctacggaatacagtgagccggaaattctgcattcagatctgagcagcctgctactttcgttattacagtggggatgtcgtgacagtaatcagttgaactggctggacaatccaccacagcccgcgcttgcagtggctcaatcgctgctgctgcgattgggggcgctggatgataatcagcaattgactgcccgtggctggcaaatggcggaggcaggtagtgaaccgcgtctggcggccatgttgtgcgcaggcaaagagcggggtgatgaggcgctggcaacggcagcaaaactggtagcgatcttggaagaacctccccgcagtgggctgccggatctcactcattggataaattcaaaccaacctcattggcagcagcgcgctaatcagcttatcaggaatcttgcgagcaagactgcaaaaataggatctaaaaaaatcagcacagaaaagattaatgctgcgcttgtacctgaactattagtacagggatttcctgatcggattgctaaaaaccgtgataatcttggccgttttcagttagccaatggtttgggtgtagcactggaacatgacgatccgttgtcgggagagcagtggctgatagcgcctacattgcagcaaaacagtaaaaaccccgatgccagagtcttgctcgcttgcccgctgaacatcgaacacactattcatcaatatccgagcctgtttacagaacaggcagccgtggagtgggataataataaaggcactctgcgagcatggaaacgtctgcagtgcgggcgtttgactgtcagagcgcagcttttagcaaaaccttctcaggcggaattacaggaagccctgctgaactgggttcggcaggaagggttggcggcgttgaattggtcgtcggaagcattgcagttgcgcatccggctgcaaagggcaacagaatggctgcctgaaattgagtggcctgcggtggatgatgacagtctgctggattccctcgagcagtggcttctgcctatgttggagggagtgggggatttgaagggattacgccagattgagctgtcgtgtgctcttctgggtctgcttgattggcagcaacggcaaatactggataatgaattgcctactaattacactgtgccgaccggaagtaggattaccatccaatatttccacgataaaccgcccgtgctgtcagtcagaatgcaagaaatgtatggagagcagcagaatccggtattggcgaaggggcgggttcctgtggtcgttgaactgttatctccggcgcatcgtccattacagattacgcaagatctcgctgcattctggcagggggcttatcgtgaggtgcaaaaagagatgaagggacgttatcccaaacatttatggccagatgatccggccaacacaacgccgacaaggcgtgtgaaaaaatatatgtgactggtttgatgcagtcagacttctatattgaataaacatttggagacttcggtatgtctgatgatgatcgtcagccaatcggacgcaaaggtaaaaaaccagaacttcgtcgtgggcgtccagcaaaaaaacgccatcggcaggatgactatgaaaatgatgaaaataatgattttgatgacgacgatgaggaagaggtcatgacgaaaaaagggaaaaaaccccgtccgccaaggagtcgatggctaggattctggttgctgctgttgaaagtatttattgtgctggcagtgctcatggctatttacggtttttatctggataacaaaattcgccatcgcattgatgggaaagtatgggatttacctgctgcggtgtacgggcgtatggtcaaccttgaaccgggcatgaattacagcaagaacgaaatgattcggttgctggaaggcatgcagtatcggaaggtgaccaaaatcactcgtgccggtgagtttgttgttaggggcaacaatattgaaatgctgcgccgtccgtttgatttccctgacggtaaagaaggacaaattcaggctcggctggtcttcagtgataaccatattgccagcatcgaaaacatggagaaccagcgtcagtttggtttcttccgtctcgatccgaaactgattacgatgatgcaatcgccgaatggcgaacagcgtttggttgtcccacgttcaggttttccggatttactggttcagactctgctggaaaccgaagatcgttatttctatgaacacgatggggtcaggccgctttccattgcccgtgctgtgttggcgaacctgatcgccgggcgtacggttcagggaggcagtacactgacacagcagttggtcaaaaacctgttcctctccaatgaacgtaccttcagccgtaaagcgaatgaagcttacatggcgttactgatggatgcccgctatagcaaggatcgcattcttgaactgtacctgaacgaagtttatctggggcagagcggcgatgaacagatccgcggcttcccattggccagtctgtattatttcgggcgtccgattgatgaactgagtctggatcagcaggcgctgttagtgggaatggtcaagggagcgtcgatgtataacccgtggcgtaatcctaaactggcactggaacgccgcaacgtggtattgaaaatcctcctgaacaggcaaattatcgatcaggaactctatgatctgttgagcgcccgcccgctgggtgtgaaacccaaaagtggggtgattaccccacagcctgctttcatgcaattggtacgtcaggaattacaggaaaatctaggtgataagattaacgacctgtcgggcgtgaaaatctttacaacactggacccggtatcacaggatgcggcggaaaaatccgtggaagagggcgttgccgatctgcggaaaacccgcaaggtagatgatctggaaggcgcgatggttgttgttgaccgtttcagtggcgaagttcgtgcgatggttgggggttctcaaccagaatatgcaggttttaaccgggccttaaatgcacgtcgtctgattggttctcttgccaaacctgcgacttatttgacggcactgagtcagccggataaataccgcatgaatacttggctggcggatgagcctatttcgatacctctgtcgggcggaaaatcttggcaaccgaggaatttcagccgtaattttagtggacgtgtcatgctggtggatgcgttggctcgttcgattaatattccgacagtgaatctggggctgggtgttgggctggatcgcattaccagtaccttgatctcactcggcattccggctaaagaaatccaacaggttccttccatgctgctgggtgcaatcaacctgacgccgatggaaatggctcaagagttccagaccattgccagcggcggcaatcgggcgaaactttcggcattgcgttcaatccttgcggaagatggtacagtgatttaccagagttatccgcaggcagagcgggcagtgcctccagaggcggcttatctgacactgtatggtatgcaacaggtggtggctcgtggtacaggtagttcactgacgaaaaaatacggtaaatacaatttggcaggtaagacgggaaccaccaatgatctgcgcgacagttggtttacgggtattgatggtaaggaagtggcgatcgtctggacagggcgtgataataatggcctaaccaatctgacgggagcaacgggggcattgaagatctacctccgctatctggaaaatgaaacgccattagtactgaataatcgtccaccggaaggcattgtggatatgtccgtcaatgaagatggcagtttcaactgtactggcaatggcatcaggatgttgccggtctggacagatgatccgcagagtttatgccagcaatctacgccgcagccggttgaggataacaaagaagaagcgccgggctggctacaagagatgtttgatcagtaatagaatatcgctccccatcgattccgatggggacattttcccggcggataacccgcagatttacaatattcccccgtaaaccgcacgttgtcgaattaatagagtgccggattcgtagctgaaaataatttttttaagtaaatataatttacttttgaatgtaatttattatgagtatatttaataaaaaaacacaccatgaaataattaaatattttgatgctttttaaatgagtgatttttactttcagactttttacattgtttattaatgcggctaatttatttaaaatataacacgacaatttttttgaagttgaccggaaattaatcgggtgtaagcatggtgattcatttaatgataaagatgaattgttatgtataaatacagtaatgatatgggtgaaataaaaaatgatcgcttattggatctctataataaacaacataaatttaaattagatgaaccagagttactcattaaaattgaaagcgccttatctctttccaatgctgattttgatttacctatcattgtattgcgtgagggcgtgttagttgccttttgtcttgcccatttatcttatcgggaaaatataaatggactgggttgtctgaatttttcaaatgttatatcttctggtgatgttgaagcattaagattcatgttcaggcagatattttttgtagcagaaattaaaatgctcattcagggtaaagatagtattctctatggccctattcataattctatattaattgatagaggatgccggactttcgctggcgaaccttttacgtataaaatgcctgataataaccttgagctatgtgacatgcttgataagataaggtgtcaaaaagaaaaagatcttatagaaattatttatgactatgactcccgagataagttacttatttctctcgatgatgacttactaatgagaacacccaaagttgattattattctgtcgatggaaaagaaatatttaaattaagaaaggaactggctgaattttataatagttcatggcaagagaattgggggtatagtcctattacagatgttgaaatgggtattgctgctgagaatatcaataatattatgggaatgattgccagaaagaatggtaagattatcggctgtacgatgatgcagtttatcgtagaatcatcaaataaagttggacgggcttttttgtctggcgtattacctgaatatagaggaacagggttatcaattgtattgacatctaaattgtcaaaaattgcgatagaaaataatattaaaagattcagtctatcttggatgttagaagataataaaataattatcggaacgatgcaacgatttatgcagtatggaaacagcaataccagacattatagaatctattcgttgtcacaagggatgtttgaaggaaacttgctatgaacctgtatgaaatagttcattcagataataaagctcagacactgaattattttcctcaagtaagatcggcttgtgagcgcgttttaactttggccgatggtacgacaaaattaaatttttcttcttgtgattatcttggcatggctaataatgccttaatgaagaatgctgcgataaacgctattcaagaatatggaacaaatatcagtgggccgatgatattctgtggctatactcgctatcatgaagaattagaaaagcgttatgctgaactttttcaggtgaatcatgcgctgatgtatacgacatcataccaagctaatataggcgctttaccggttattgccgaagatattgagcttattatcatggacaaactttgtcatgtatctttatatgatgcagtaaaattgagtggaaagccatttcgtgtctatcagcataataatatgaaaaaattggctgatattataaaaaataatatgggtaaaagaattctgattgtttctgatggtgttttctccgcagatggcgatttttgtaatatcccggaactctgtaaactaaaatcgatttactctgatattatgctttacattgatgatgcacatggtgttggcactttaggcgaaaatggctgtggtttggttgaagtatcggggtgtcttggtgaagtagatattatcattggtacgatgagtaaatcttttggttcaacaggcggtttttgtatcatcagagatgatattttggcacaaaaagtaaaatataaaagttcgacatataatgcctcccgttcagtttcacctggcgtggctgccgcatcttgcacagcattacagattaatcaatgggaaggtaaagcccgacgagctaaactggttgaattagtgacttatgcccatcagcgtctggaaggtacgcgtgtgaataaacagttatctgtttctgccgttattccagtgatttttgagactgtagaacaggctatcgcggtaaatagttatttgcttagacataatattatggtatcgcttttcgtaccgccttatgttgaaaaaaataaatctcgattaaggataacgataatttatcatcataccaaagaagatatagatacactggttactgtattggataacgccatagagaaagtcatctgctgaagagagggctgtacgttatgctgatacacataattttttccatcgttatattggtctgtagttattggttattgtgtgccattttaggcactttagctaaacaacataatattaaaattaactataccagaaagattggacatttctcgatgtttatatttcctggcatcgtgtatgcttttttcaatattattgaaacagccgataatctggttattgcgtcactctcgagtattattttttttatcagtctttctcagatgtttaggcgtagatttaaataccttgcatcatcatttcatgctattgacaggccagaggacagaccctatacattaatatggattttttctcagaccattgtcggttttctgattttagctgtattcagtgtgttttggggtattctgggaattccctatgaattaatgtacatgactatcctgacgacaacgattggtgacgggctagccgaacctattggcgtaagattcggcaagcataaatatgcagttaaaggttttttgatagacaaagtattttaccgtagttatgaaggcagttttactgtatttattactgcactaatattgggattggtttttatgtatcgttttagtccattgggggcggcactgatgattctgtgtttcccattaggaatggcgttaacggaagctaaatcaccacacacatgggatacaccatttctattttttgtcggaaatttaattataacggtggcttatttattatgataatacttattcgtcatgcaacgcctaaaatcgattattctacctgtaattctaaattggcccagcagcgactgctttcatacaatgaaacgagggatatcgatgaaagtgaaatggacgggtttatggcatcctcattatatcaaaaaattaaagatgccaaccctgtcgtatatagttcaccggttggccgtgccgaacgaacttgtcaggttttatttcagcaaccgaataattattttatcaaaggtgagctgaaggaggttgatctggaaatatgccatttaccctttataaaaatgaaagtcagaagttggtttttcttttctcgtctggtttggattttgggaataggtaaagaaaaagaaaaaatgaaacatgcagcaatacgtgctaatcgggtatttaaattgttagatgaaaataaaaatatcgttattgtatcacatggttatcttatccattatgtgaagaaagaacttaaaaaacaccattataataatattgagaaatataaaaaaggatgttttactgtggagttatatgataaatgagaaaaatccttatcattggtgcttctgggtttattggtaaaaaagttgcagattatttaagccatagtggagattttgatgttattcgctattcccgttttcagcaggaaggttatttttcttgtcttatcggcgatagcgattgggtaaatatgattgatagttgtgaggcaatcatcaattgttcaggcgtggggctggctaaacttaaaaaaaatcaaagagctaatgaagatattgcaaaacagattgtcagatctattcctgattcatcagacaggaaatataagatcctacatttaagttctgtgaaagcctataatgctaataattataaggatatatactctattgataagtgccgatcagaagcggtatttttccgtgggaagcataaactctttggtgaattgttacgtattccggctgtattcgggcaagacgataaaaatctgcaacctcttgtccgtttagcgagaaaggggcaactgccgggtatcaatagtcatatttctgattggcactgcataacgaataatgatgtcgcatattatatatattgctggctaaataaagataatttatcaacgttaaatattagttatttattaagtgaaaaacgatatagtatcaatgatctggttgaatctattaatcactctgttcatggtaatggatatcaggccagaaaaaaaagtttaatgtacattaaattaatttattctctattagccgtaaaaagttacatttcttccgggtttaaatcgagtaatttcccatatgcgcgatatcaggatctttttgagcgggactggaaaatagatgactcagatggaatagatatccataccattgatgtgaatctggctgatatatggaatagtctatgaggaaattccgctattctctttttattatcttcctgataccaataataatttcatggtggagttcttatgtatcagggtatcggaatactgttccatactttgttgcttctattgcggttttaaatgaattgttttttctgaatgaagtttcaaatgtaaaatcaaaagatcaaggtattgtcagtgcacttgtagtttcggcaatgatgtcattgttgctctatttttctgctggcagagcagtcatgtatttacatctgttactcagtacggttttgattcttataggcagtggaatgcgtactttgtcgaagataacattggggatatatttttcacatacactgcgcattattaataatcataagctaattaatcatggtgtgttcagattaattcggcatccggcttatagtgtgacaattataattatgtccggttttggtttttttgttagtattagtatggggctagtatgtttttttatttttttcattctttctatgcgtagaattgaaagtgaggaaaatatgatgatggaaaaatttggttcagaatatttagattatagaaaaaatacctggaaattatttccgtttattatttgatgttaagaaaggattaatcttatgagttttaattctgttaatgaaaaaataaaaaaaattgttgctgaaattcttgaaatgaatagttgtgaattatctgacaatgccatctttacaaaagaatatggggcggattctattacagctattgaaattctggcggctatagagtcagaattcgaaattaagctgcccgaaaattttgctgataaaatgattagtctcaattctatttatactgtgatgcaggaaatttcaatttcttatcctgaggaaaacagttaatgaataatgttgagcgagaaaggattgtggtgacaggattaggacctgttcatgctttgggggttggaaaaagcgcattttttagtgcgctgtctaaaggcatcaatggagcgaaagagacccgttccattgatgtgcaaaactataaatatcattattcttgcgaagtggagaatattgatcccctgctctacggtgtttctgaattacccgctgggataggtaaagcgagcctttatgctattgttggttcccaattggcgattgaggatgccggcctgtcactggcggatttagaaaataagctagtgggatgttttttgggcaccactgatggcgagtctcaattgattgatgggatcgttaaagggattcaaggtggggatgcagttcccgcgggaacatttgacaatgcactgcattcacgtatcagccgtaatgtcagttcatatctaaaatcaaggggacccgcttatacgataggcaatgcttgttcagcgagtaatgcgtcaattatttctgccgttgagtatctgcaagacagcgacgctgagtttgccatttgtggtggcagtgatgtggtctgtcggaaaacattctctatttttcatcgtttgtctgcaataagcgagaagctttgtacgccgtttgatgttcagcgcaagggaattattcccgcagaaggagccagcatattgttactggaaaagctctcttcagcccgtgcccgtggtgttcatatttatggggagattgttggctatggtatgagctgtgatgcaacccatatgactaacctcaatccggataagatcagagattgcctgaatacatgccttgagagtgcgggtctgtctacttttgacgttgattatatttctatgcatggaactggaacgatggccaatgacttcaatgaataccaggcgctgcaaaaggtttttactgataatatcccgatatgtggttcgattaagtcgatgattgggcatgcgatgggagcggcggctgggtttggcgcaattgcttgtatgttttcatttcaccatggtattccgcctacgattaatgtgtctgagcaagatccagaaattaacatcaccatcactgataaacttttacctaaagacgttaagatcgcgatcaataatgcttttgcttttggcgggaataattccatcattgcttttaaaaaggtaaatgataatgagtgaattttctttaacgattagaaattggtgtagcctcaaagatggaattcaaacaggcaacagcccggctttaacatcagatgattgtgcacagatagatgaaaaagttgttttggcgggtaaaaaactgcgtaatattgatactcagacaacaaaagttctttgctgttttgacgcgataaaaagagcaggaaattatgatccccatgccgctattattagcgcaacatcaatgggagcatttgacagtgtttgtaaattattggaagaatcttatcagaatgccttaccctatcagatatcgccgggtaatattcctaatactgttattaactctacggcaggttttgccgcgattcattatgaagttgacgggccaaatattagtttgtgtgccagtgaactttccttttatgaagcgttgaccaaagcttttgccataggtaaacgtcgtccggctaataaaatttttgtcagtgcagttgaatcttgggggggattatatggtcgtgctttgaatgaaatacgtcaagatgagcatttccccgttgattattacgcggcactctttatgttgtctccggctgcatggaatgttgttgatgatattgcaggggataaaatattggctgtaactaccggccgattaggtgctgaagaggatattactgccaaagcggtcgattttattaattccgtggggatcaggcctgaattggttcacacattgaatatctgggcagtctcacagaataatttgtcatcatttaaccgctacttcccacatacttctataacacagctctcttcgtcggcgaaggtactaatgtctggtttaggtgcatggcaactggagcatcttttgacaaagacagccgcgaataaatatggcgttcagatagccgttgatgatgaaggattctatggattatctattattgaaaaattatgattaataaataagaatccacttttatgttaaaaaacaaattaaataaaacgtgtttttatggacaccatcatcaggcgtttctggggcattttcccggaaactcattgttacccggagtgtattatttacgtgaagttttggcgttattaccggaggaaattactcgattttcttatatagttaaatatgcgaaatttattaagatggtaacgccgaatatttatcttaattatactattttgatagacgaaaataactcaggtgaacatattgatatatcttctactattcaggaagttgatggggacattgtcgcaaaaataaaaattactttcaaaataagtgaataaaatggactgtgatacaaaaagtaatattgaaattgttgggaagaatctacacagatatcccatggtattgatagataaagtcatacagcagggagagattgttattacggaaaaatatatttctcttaatgattttgtattcagaaatagtgattttaatcagcataacgattttatttatccaagttacctgatcattgaatcattttttcaatcggccggcctattcatttgtgaatgtgatattttaccttatgtcatcctgtgcaaaaatgtagaagtgaaacggcagatttatgcaggagaaataatccgtcatcatgtcaccctcagtagcagaaaaggcagtcttattattgtcagtggtgaaagcagaagtcagggtgaatcggtaatatattatgagcaggtgtatattgggtttcagagacagggcattaagagttaaatgatattacctgatagatttcaagccgcagagcggcggtaagtgagctaagccaacaactggtaataagttgaaagatgaagaatataagacgccacaggattgtggcgtcatgaataacggaatgacttaattcagtctggcaaagcagcgagcggcggcatcaacggtacgctgaatatcttcatctgaatgggcgatggacataaagcctgcttcaaacgcagaaggagccagatagacgccttcatccagcatcaagtggaagaattgcttgaagcgttcaacatcacacgccatgacatcctgatagcaagtcacgctttctgcgtcggtaaagaaaataccgaacatcccgccaacgtggttaaccaccagtggaatacccgccgctgatgctgcttttttcaggccagaagctaattggtctgtcagttcgctcaaacgctggtgaacgccgggttgggcgacttcattcaggcaagccagacccgcagccatagcgatagggttaccggagagggttcccgcctgataaaccgggccagtgggtgccagtttttccatgatgtcctgacggccgccaaatgcgcccactggcataccgccaccgatgattttgccgagggacgtcagatctggctcaacgccgtaatactcttgtgcgccgcccaaagcgacacggaacccggtcatgacttcatcaatgatcagtaaagcgccgaattcatcacacagcttacgcagacctggtagaaattctggtcgtgggggaatgcagttcatgttaccggcgacgggttctacgatgatacaggcgatctcttctgggtatttttcgaaggcttcacgcacggaattcaggtcattatagacgcaggtcagagtatgtttggcaaaatcggcaggaacgccgggagaattgggctggccgatggtcaaggcgccggaacccgctttcaccagcagacagtcagcgtggccgtgatagcagccttcaaatttgatgatcttatcgcgtccggtataaccccgtgccagacgaatggcgctcatggtggcttctgttcctgagttcaccatgcgaaccatatccatggaaggcaccagctttgtcactaattttgccatttccacttcggccgcggtcggcgcaccaaaactcagcccccgctcggcggcttcaatcacggcgttgcgaatggcaggatgattgtgccccagtaccattggcccccatgagccgacataatcgatataggcattgccatcaacatcgtaaaggtaagcaccatcggcgcgttggataaagacaggtgtgccaccgacaccattaaaggcgcgtaccggtgaattgacaccgccggggatcacctgttttgcctgagagtaaagtatttcggactggctcattaataaaagctcctgaaaaaataagggtacagatagggggaggccattttaaagcagcctgatggggaagccaaatcatcctgacatggagaagcgtgttgccttggtgtagcaaaacttgaacgaatcagttaggtatcggataatcgcggctaactgatcagaaggtttaaaacgactttctgagaatttttaccgaaacaccggtctggagcaaaaaaatgagcgatgatgctgcattgcctttgcagtttactgatgccgcagccaataaagttaaagtactggttgctgatgaagataacccgaacctgcgtctgcgggtttatattacaggtggtggctgtagcggtttccagtatggtttcactttcgatgatcaaatgaacgaaggtgatctgacgattcagaaacaaggtgctgagttagtggttgacccgatgagcctgcaatatctggtgggtggctgtgtcgattatacggaaggactggaaggttcccgttttatcgtcactaacccgaatgcaaaaaccacctgtggttgtggttcttctttcagcgtctgatcgaaaatatgataccgttattaaaaataagggcagcttaagagccgcctttatttttttctacgttggcctctagccgccagaaagattaagctcccggcaaagctgctctgtcgccagaataattcgtggccctgcacggctgaaccaatcgtcattcagggtgatgatcttgacattcaactgtggctgccaaaaatccgccacgcgctgtttttgatcttcagttcctcccagcacaatcacttcaggtttgcgtgtaagtacttgctcacgattgacttgcggccacggtacagtgctgtcggcaaagatgtttttaccaccacatgcggatacgatttcactttgaatggtgtgaccggatgaagtaaaaatcggattcataccaaattgtaaaaacacaagcttgggattgggggtggcatgggtttgttttaatcggctgaatgtctggcggatatcagcggctgattttttggcgatatcggggcgtgggctatagacagccagtcgttccagatcggttgcgacatcttccacttttttcacatcagaataaaaaatcgggatacctaatgccgcgagctgttctaacggacgctggggattaccgccgcgccaggccagaatcagatcgggtttcagggcaatgatccgttcaacattgatgccttgccaatcagcgacttgctctagttttttggcggcttcgggataatcggagtaagcactgattgcaacaagccgatcgcctagtccagccgcatacgcgagttcggtcgtcgagggagcgaggctgataacacgagaggctgcggcgtgaagtggcgcactgacactatacagaaaactaaagagcaggaatgagaatgacaaccagattgatctaagtgagattattttcatccagagtttcatgatcggtgctccacttcaattaattgattaattaatgttggctgagttcgctcaacatggcgttgaccatccgtgttgattcacgggcagcgataactaagaattcatcaaagctgatatgagatttctgatcggcaacatcagaaatggcacgaaccaccacgaatggaatttgatactggtggcaaacatggccgatagctgccgcttccatttcaaccgccgcgacttgcgggaaagtagcacggatacgcgccagaggttctgcgccattgataaaagcatcaccgctacaaatcagcccacgaactgcattcaggtcaagggatttaatgcatttttcggccagtgtaattaattggctgtcggcgataaaagcaggtggacattgtgccatttgacccggctcataaccaaaggcagtgagatcggcatcgtgatagcggacttctccggaaaccacgatatctcccacattcagtttagggtcaaggccgccggctgatccggtgttaattacgatgtctggctggcaatgttcaatcaacagggtagtgccaagagcggccgagactttaccgatgccggatttcagcaacgcgatgtcaacgccattcagcttgccggtgtagatttcacatccgccccgcgacacagtttgcagaccttcaatctggtcacgcagtagtgttacttcttgttccattgcgcctattacacctactttcattgtgtcatactcatggttaattaatggattagtgtctatgaaaaggcactcttattcgatgcggcagtgtaacattgaatcactgtttactggatattccggctataaataagcgtttcattcggtatggggggattaatgactaaaattgatttcaagcagaagttgaattaccagcgtaagtacagcaactcttccatacatcctgacgatgaagatcaggtgaatcgtcaattcgaaagtgaccgtgggcggatcatcaattcagccgctatccggcgcttgcagcagaaaacgcaggtttttccgctggaacgcaacgccgccgtgcgcagccggttgactcactcgctggaagtgcagcaaatcggtcgctatatttcaaaaacgattattgcagaactgacaaagcaaaatctgctggaaaaatatgggctgagtgatcgcttacttgcttttgaaagcctgattgaaatggcctgcctgatgcacgatatcggtaatccgccgtttggccattttggtgaggctgcgattagagattggttctcgcgtcgattagatcctgattatttttcagattgcgcttctgaaagcacagctcggcaagatggctgtaaagtggcggcattgagctacaatggtgaagccaaaaaagatctgttccggcgccagttacgtaaggatttatgtgagtttgagggcaatgcccaagcgatccggctggcacataatctgcttaaactgaatctgacttatgcccaaatcggctgtatcctgaaatatacttgcccggcttaccgtcttgaaggatctcccgaagaattcagttacctgatgaagaaaaaaggctattactggtcggaagacagttttatccatgaattaagaaaagagctgcaattgggagatttctgccgttttccgctgacgtatattatggaagccgcagacgatatctcttattgcattgctgatttggatgatgcggttgaaaagggcattttcaatgttgaacagttggtggaatacctgaaaaaagagtggcaggaaaatgggggacacaggaaaggggatttatttgaattcacggtgatgcaggctcataagaaaacggccagcaatgaggctcgtcgcagtattcatgagcagtttttcatgtatctgcgggtatttatcaccggaaaattggtgccctataccgctaaacgttttattgagaatttgcctgaaatttatgcaggtacattcaatcatgctttgttggaagagaatggcgatgagcatcgtctattgcagattttgaaaagtgtcacgcggaaatgggtatttaaccaccctgaagtcgaagagctggaattgcagggctatcggattattaccggattgctggatgtttatagcccattattggagctatctcggcaggattttatggcgctgcaccgagataattttcacaaaaaatactttattgaaacgcgcctgctgcacaaattatctaccaaacaccggctggcctatgaagaggcggtagaaaacattgtcgccactgatgaagctgaaaaagatgtgctcgaattttattatcgggcgcgtttgattcaggactatatcagtggcatgactgaccattatgcttacgaagaatatcgtaaatttatggtatcgaagtgagaggcccggcggtcgctctaagtacatcaggagccgcggcaatgacgtgattgatctcatcgatgaattccagtaattctggctccagatccgccagaggaatagcttgtttcagttgtttttcgatgaattcacaaatcgcttgcagtttggggacgccattgtaacagcaactgccatgtaattggtggacatgatgctgaaactgtttgtgatcaatgtcgctatctgctgccaagatctgttcaatcatcgctttcatttctggcagcgattgtactagcatctccagaacttcccgcgccagagattcttttccggccgtttgtttcaaagccatatcccaatcgatgaactgtgattttttcttttggctgtattgattcagccacgttttcaggcgacgttcatccaatggttttgacaggcagccaacaaacggggaacgtcccccattttgggtttcattacagggaaaagccgtcacggccacaatgggtgtctctttatgctgtggtaattgatggatctgttcagaggtttgaataccatccatatctgccatctgaatatccatcagaatcagatccagtgcgtgttgttgtgccgtagtcagcgcttccagaccactgctgcacagcagggtattctcgatttgttcgtccagcaaagtaccaattaatttcagattggccggattatcatccaccgccatcacggttatgggcaaacgtggaaaaaccgagggaatgggcaggcgttcaggtaatgaacccaataaaaacgcttctttttccagccagagatcaaaataaaatacggttccttttgcgggttcgctgatgaaatcgatctctcccttcatttcattgaccagccttttggtgatactcaaacccagcccggttcccccgtagtggcgggtaatgctggcatcggcctgattgaatgcctggaacagaatcggacgatattctggtttaatgccgatgccagtatcggttatggtgaaatcaatctgcacgagatggtgctgctgctgacgcaatttgacctccagtatcacgctgcctttatctgtgaatttaatcgcgttgccaatcaggttagtgagtatttgctgcaagcgaatgggatcgccgatcatcaggttaggcaatttgtcatctatgcgatgatgcagggggaggtttttctcgctggccgcgggagtgagcaattcgatgacttcattgaccgtatctcgcagtagaaaaggaacttgatccagcaccagtttattcgattccagccgtgaaaaatccagaatgtcattgatgattttcagcagattattggcagaacgctcaatcacataaagatattcggcttgctgagaagtaatgggtgttttgagcatctgacgggtaaagccaataacgccattaagcggcgtgcgtaattcatgggacatatttgccagaaattctgttttgatcttaaccgcttcctgtgcgcgttttttggctagagtcagttcaacgttttggatttctaattgttccatggtgatttgtaagtcagatgtggcctgatcaatatgcaactgcatctcatctttatatttcgacagcgattccgcgacggtattgatgccattctggagtgcggccagttctcccggcatcgcgccagtgacacgaatgttcaattgtccctgccgtatccgttctacgactctcaccatgtcacccagtggctgtgtcactttgcgcaccaaaatgtgggcaaacagggcagtgccgccaagacagaggatcagcaggatgattgacgtcgtaatttctttatattgctggatttgggccgttctcaaatccagatcaatggcgatatagccgatgggattggctttgctggtggtattgcgccattcgttttcttgggtgttttctgcaatcagcggcatcatcaaaatgatattattatcgtgtcctgattgactcagtaggatctttgggattggctcaccagcaggaagccgcaactggttcgcatcatatttatcattagaaatgtcgaaaagcttatgatttttatcaaaaatcgcaatggctttgacaatctcggagttacggcgatgcaggctattgactaatacttcgacccgtcgatgattatccagattgatgcccacctcgctggcgatagacaacggttcaataatgctgatcccactgcggactatcaggttcttcaactcgtaataacggtatgagataaatgatatactcaccagcgttccgaccagtaaaacaggaaccaatatcaggctcatcatacgggtgcgtaggctatatttggtcataagcgtccattgtgggaaaatcaaaactcaatttttcaaagtcagtcagaatcatggtgcaattttactccccaaaccgccgctccgtaaaccgaggcattatttccgttaccgcagataaccttgatgcacaagggcaaggtattgcccgtcatcagggaaaaacgatctttattcagggattattgccgggtgaacaggcccaaatccaactgacagaagaaaaacgccagtttgccaaggccaaaatagtaaaacggctatcagacagcccgtctcgtgttgtaccgcgctgcccacatttcaatgtgtgtggcggttgtcagcagcagcacgttgcgattgagctgcaagccaaaactaaggccagcgtgctggaacaccttatccagcgagaaactggcaccagtatcagtgctcatcccattattcacagcccggaatatggctatcggcgtcgggcacggcttggcctgcaatacgatgttaagaaaaacccggccaggcagcaaaaattattgatgggatttcgccagagccagaccaacgatttggtggccgttgcacattgtccggtaatgcgccctgaattggaacagttattgcaaccgttatcccagtgcctgaatagcctgagtgcggttaaacggctgggacacgttgaattggtgctggcggataatgggccgttaatggtgttgcgtcatcttgatccactgaagtgcgaagatagggaaaaattgtgcactttttcggtgcagcataaaacggcagtctatctggccggcgatgaaaaatcccttgagcctttgatagaagggcagtctgctccgtggtatcaggtggatggcttgaaattggaattcagcccgcgggattttattcaaattaatgatgaagttaaccagcaaatggtggcacaggcgttggcctggctggatttgcagccgacggatcgggtattggatctattttgcggcatggggaactttaccttgccaatggcgcctaaagtacaggccgtagtgggtgtagaaggggttgccgccttggtcgcgaatgggcaatataatgcccagctcaatgaacttaataacgtcgattttttccacgaaaatctggaatcggatattcaccagcagccttgggcggtgctggggttcaataaagtgctgctggacccagcccgtgcaggtgcggcgggcgtcatgtcacatattgtaaaactggcccctgagagagtggtgtacgtttcctgtaaccccacaacgctggcgcgggacagcaaagttctgctggaggctggttatcatcttgtcagtgtgcggatgctggatatgtttccgcacactagccatctggaatccatggctttgttcagccgtgagccagtggctatcgagtagggaggaattatggttgcggtaagaagtgcacatctcacaccggcaggtgaatttgcggtcgataagtggatcacgagtttaaatatcacgaatccacaatccagtgagaaattagccgaaacatggcattactgtcacgaaaaagtccaggatcaccctgatgcggcgctgttgctgtggcgcggtgtggaaatggtggaaatcctgtccacattgagtatggataatgacagtatgcgcgctgcgctgctctttcccatccttgatgccaaactgctcgataatgaaacagtgacagaaacatttggcacggccattaccaatctggtgcatggcgtgatggaaatggatgccattcgccagttaaaagccacccacacggattccaccagctcagtgcaggtcgataatgtgcgtcggatgctgctgtcgatggtggaagatttccgctgtgtgatcatcaagctggcggaacggattgcccatttacgggaagtgaaggatgccagcgaagatgagcgagtactggcggcaaaagagtgctccaacatctatgcgcctcttgccaatcggctgggtatcggtcagctaaaatgggaactggaagatttctgtttccgctatctgcatcctgatgaatacaaaaagattgccaaactcctgcatgagcgccggatcgaccgcgaacagtacatcggaaagtttgttacgaccatacgcaaatacatgctcaaagaagggatctcggtcgaaatttatgggcgtcccaagcatatttacagcatttggcgcaagatgcagaaaaaatccctcgcctttgatgaactgtttgatgtgcgggcagtgcgtattgtcgttgagcgtttacaggactgctatgcggctttaggaatagtgcatactcactatcgtcatctgccggatgaatttgatgattatgtcgctaacgccaaaccgaatggttatcagtccattcataccgtcgtgctggggccgaatgggaaaacgcttgaaattcagatccgcacccgccagatgcatgatgatgctgaacttggagttgccgcccattggaaatacaaagaaggcaccgccattggcggcggtaaatcgggcagttatgaaagccgtattgcatggctgcgtaagctgatcgcatggcaggaggagatggcggatactggcgaaatgctggatgaagttcgcagccaagtgtttgatgatcgcgtttatgtctttacgccaaaaggcgatgtgattgacttgccggcaggctctacgccgttggattttgcctatcatattcacagtgatgtcgggcatcgctgcatcggggcgaaaattagtggacgcattgtgccgttcagctatcagcttcagatgggggatcaaattgaaatcatcacccagaagcatccgaatccaagtcgtgactggctgaatccgaaccttggctatgtaaccaccagccggggacgagcaaagatccacaactggttccgcaagcaggatcgtgacaagaacatcattgccggccgccagatgctggacaatgaactgacccatttggggatcaccgtcaaggaagccgagaaagaacttattgcccgttataacgttcattcgctggaagaagtgttggcggggattggtgttggtgacatccgtattcaccaattgatgaatttcctgcaaagcaagttcaacaaaacgacggcggaagaagctgatcgtaaggcgctgcgcaatctagaaaataaaacctacactccgcgcaatgtaaaacaagacaatggacgcatcgtcgtggaaggtgtcggcaatctgatgcaccatgttgctcgttgctgtcagccgatccccggtgatgaaattgtcgggttcattacgcgcggacgcggaatttccatccacagtgctgattgtgagcagttggccgaattggaaattagcgcaccagagcgcattgtggatgcggtatggggagaaaattattccagcggctactcccttgtggtgcgggtgcttgctaatgatcgcagcggattactgcgtgatatcaccacgattcttgccaatgaaaaggtaaatgtactgggggtgagcagccgaagcgacgtgaagcagcaattggcgactatcgatatgaatattgagatttataatctacaggtattgggacgggtactggcgaagctcaaccagctatctgatgtgattgaagccagacgtttgcacggtaattaatgaaacatggataagataaaaaccacttcgattgaacgacttaaggggattatgacgcagttgcgccatccccagcagggttgcccgtgggacaaagtgcagacttcggccaccattgcgccttacacgctggaagaaacctatgaagtcattgatgccattgagcgcaacgacgcaaatgccctgaaagaagagctgggggatttgctgtttcatatcgtgttttatgcccagatgggccaagaacagcagttgtttgattttgacgatatctgcgacgcggtttgtgacaaattagagcgcaggcatccccatatttttgatcaacaggcaggcatcagtagcgaagaagcgatagggagctgggaacagcgtaaaacagcagagagggcggaaaaagaccagcattctgtgctggatgatattcccgccagtctgccagcattgatgaaagcctataaaatccagaagcgctgcgcttcggttggttttgattgggatacacttggcccggtgctgggcaaggtgtatgaagaaatcgatgaagtgatggatgaggcccggcaggcggttgttgatgaagcccggctggaagaagagctaggggatttgttgttttctgtcgtcaatttgtcccgtcatttagggcataaaccagaaatggcattgcagaaagcctgcggtaaatttgaaaagcgtttccgaagcgtcgaaaagcgtgtcctcgaccaaggtctgtcattggaaacggcgacactggaggaaatggaacagatgtggcagcaagtcaaaaaacagcagtcatagggcagaaatagcgaaaaaaacgtcgtggaatcgccgaataacctgaatcaggtgaaaattttttaaactattaacttgatgaatttaaagagaaagacatcggctggtttcgcgctgtccctaataagtcggcactttatcctgcctagatggtttgtagcgcatttaaggttagggtatactgctttcccgtcctgttatattcatcatccttttaaacctaaactctcaggttcagcatgaaaactaattatatttttgtgaccggcggggtcgtatcctctctgggtaaaggcattgctgctgcctctttggcggctatactcgaagcccgtggactcaaagtcaccattatgaaactggacccgtacatcaacgtcgatccgggtacaatgagcccaacccaacacggggaagttttcgttaccgaagacggcgctgaaactgatctggatttaggccattacgaacgtttcattcgtaccaaaatgacacgccgcaataacttcacgaccggtcgtgtctactctgaagtgctgcgtaaagaacgccgtggcgattatctgggtgcaaccattcaggttatcccccacattaccaatgaaatcaaagatcgtatcatccgtggtgcagaaggctatgatgtggtgctggtggaaatcggcggcactgtcggtgatattgaatctctgccattccttgaagctatccgtcagatggctgtggaagtaggccgtgaacataccctgtatatgcatctgacgctggtgccatatctggcggcggctggtgaagtcaaaactaagcctactcagcattctgtgaaagaactgctctccattggtattcagccggatgttttgatctgccgctcagatcgtattattcccgccaatgagcgtgcaaaaatcgcgctgttctgtaacgttccagagaaagccgttatctctttaaaagatgttgattccatttataaaatcccgggtctcttgaaatctcagggcttagatgattatatttgtaaacgatttagcctcggataccctgaagctgatctgtccgaatgggaacaggtcgtttatgaagaagctaatccatcgggtgaagtcaccattggaatggtgggcaaatatgttgaactgccggatgcttataagtcagtgattgaagcactgaaacacggcgggttgaaaaaacgcctgaccgtcaacatcaaactgatcgattctcaggatgttgaaacccgtggtgttgatgtattgaaaggtctggatgccattctggtgccgggcggcttcggtggccgtggtatcgaaggcaagattatgactgcacgttatgcccgtgaaaacaaagtcccttacttggggatctgtctgggtatgcaggttgccctgattgagttttcacgtaatgtggcgggcatgaaagaggccaactccacagagtttgagccagagtgtaaattaccggttgtaggtctgatcacggaatggcgtgatgagaacggcaacttagaagtacgtagcgaagagagtgatctcggcggaacgatgcgcgttggcggccagttatgccgtctgtctgaaggcagtctggtacgtaaactttatggtcaggacgacattattgaacgtcatcgccatcgttatgaagtgaacaatttgttgctgaaacgcattgaagaagcaggcctgcgtattgctggccgttcaatcgataacagattggtggaaatcattgagaacccggcacatccgtggtttgtggcgtgccagttccacccggaattcacttcaacgcctcgcgatggtcatccgttatttgcaggctttgttgaagccgcaggcaaatatcagaaaggccagttgaaataagatatggggcgattgattggttttaattgtaatttattgaattttaatgaatttaatttcaatcgattgcccggaatttaacttgtactgaggaaaacctaatgtccaaaatcgttaaagtacttggccgtgaaatcatcgattcccgtggtaacccaacggtagaagcagaagtacatctggaaggtggctttgttggtctggctgctgcgccatcaggtgcatcaacaggttctcgcgaagcactggaactgcgtgatggtgacaaatctcgcttcatgggtaaaggtgtactgaaagcgctctctgcggttaatggcccaatcgctcaggctctggttggtcaggatgcgaaagatcaggctaacatcgacaaaatcatgatcgagctggatggtactgaaaacaaatctaacttcggtgctaatgcgattctggctgtttcccttgcgaacgctaaagcggcagcagcggcaaaaggcatgcctctgtacgagcacattgctgagttgaacggtacgccaggcagattctccatgcctctgccaatgatgaacatcatcaacgggggtgagcacgctgacaacaacgtggatattcaggaattcatgatccagccaattggtgccagcacgctgaaagaagcggtacgcatcggttcagaagttttccaccatctggcaaaagtgctgaaagcaaaaggcatgagtacggcggttggggatgaagggggttatgcgccaaatctggaatctaacgcagcagcgctggccgcgatcaaagaagccgttgaacaagcgggttatgtgctgggtaaagatattactctggcgatggattgcgcagcttctgaattctataacaaagaaacgggcaactatgaactgaaaggcgaaggcaggacgttcacgtctcaggaatttacccactatctggaagacctgaccaaagaatatccaatcgtttctatcgaagatggtttggatgaatctgattgggatggttttgcttatcagactaaagttatgggcgacaaaatccagttggttggtgacgatctgttcgtaactaataccaagatcctgaaagaaggtatcgaaaaaggcatcgcaaactccatcctgatcaaattcaaccagattggttcactgactgaaactctggctgcaatcaagatggcaaaagatgcgggctacactgcggtgatttctcaccgttctggtgaaaccgaagatgcgactattgctgacttagctgtgggtactgcggcaggtcaaattaagaccggttctatgagccgttctgaccgtgttgctaaatataaccagctgatccgtatcgaagaagcactgggtaaccgtgcgactttcaatggtctgaaagaagtgaaaggtcaggcataattgccggtcgatatcgataaaaaataaattttatttatgttttggcgaaagagtatatgctctttcgccatctcaacaaaagataattttatccatataagtgattatatacacgatgatgaaatgaaaagtatgaaataacggcacaatatccgtatgttttctaaacaatcattcattaattgaacaaaccccacgtgatagatcccaaaatcatacacgttgtattttcttccttgttaatactccttattatttcacatgtaatgtaattctttaacatttatggcaatgattcatcaataattctttttacattaccgtgttgtgtttcattgttttacggagtcttcatggacgcttctgaatctttaaccccagcgattgggccaaatccctcaaataaaagaggcttaattattctcgcgctggatattatcttgcttgtcgctttgcttaagtttttgccgtatggcgaaaaaaccaatgcgggtctggcattgatggcatttgttggtgtgctatggctgactgaagctatacacgtcacaattacggctctgtgtattccaattctggctgttggtatgggattaatgaatacgggtgatgcgctgcaatcttttgcaaacccgatcatctttctgttctttggcggttttgcactggcaacggcattgcatattcaaggtctggatcggctgatcgccaaccgtcttctgatgattgcccgtgggcgtttatcggtggctgtattgctgatatttggtattacagccgtgctttccatgtggatcagtaacaccgcgactgctgcgatgatgctgccgctgatactgggtattctggctaatctggatgtgcgcactgaacgcaatacgtttgtttttgtgttgctgggggtggcatacagcgccagtatcggtggtttgggaacactggtggggagccccccgaatgccattgcagcggcgcaactgggtatggacttcttcacatggatgaagtatggcgtgccgatggtcatcattttgttgccagtcatggtggccgtgatgtatatcatgctgcgtccaaacctaaagcataaatttgatctgaaattggaacatctggagtggaacagtaagcgtattatcactatggctatcttcttgctgacggtgtttagctggattttcagttcaatcatcagtgatgcttttggcggtatcaaagatctggatacgattattgcagtgagcgcagccatcctgattggcatcactggcgtgtcaacttggtcacagattcagaataacaccgaatggggcgtattgatgctgttcggtggcggcctgacgctgagtgctgtcctgaaaaactccggagccagcgaagttatggcgaatggcatggcggcaaccttcggtgccagtcactggtttgtgatcatccttgctgttactgcgttcattatcttcctgacggaatttaccagtaataccgccagtgctgccctgctggtgccaattttcgctacggttgcagaagccttggggatgcctgtcatggtgctgactatgattatcggtatcggtgcatcctgtgcatttatgctgcctgtggcaacgcctcctaacgcaattgtttatggctctggctatatcaagcaaattgagatggtgagagtgggcatggtgctgaacgtggtatgtatcgccattatctctgtggttgcctggttcttctggttgtaattcatatcaataaaaaattgatcataaaaatcgccacccggaagggtggcgattgtcttggaacctataactattctttcgtactaatatagatgtttttcacctgagtataggcatccagactcattttatgggtttctctgccaagaccggattttttgtaaccgccaaatggggaatgggcgggcagggcatgataggtattgacccacatgcggcctgtctgaaccgcttttgccacgcgcagagcacggttgatatcctgcgtccagacagcgcctcccagaccgtattcagaatcattggccatttccacgacttcttcttcactgctaaatggaatgacacacagcactggcccgaagatttcttcctgtgcaacccgcattttattggtcacattggtaataatggttggctgaacaaagaaaccatcatcgtatcccgcgcctgttatgcggtttccaccagttagcacagttgcaccttcctgcttcgcaaggtcaatatagcccagaataaagtccatttgctcctgactgatctgacaagccatctcggtttcggccatcatgggatcgcccacccgaacggattcaaatgccgctttcagcgatttcaggaactcgtcatgaatatctttatgcaggaacaggcgagcgccagattcacaggcttgcccctgatttaacaaaatgccgtcagcagcatatttgacagcctttttcatattggcatcagggaaaataatgttggcagatttaccgccgagttctaatgtggcagggatgatccgtttggctgccgctgcggcaacgttgtaaccgacttctgttgaacctgtaaaggctaccttgtcaatgccttcatgatcgaggatcgcttgaccaacactagacccgcgacctgtaacgatattgacaacgcccgctggcagaacttgattcaagatacgacctaattcgagcaaactgattgaagtcaggctggcggggttgatcacgatggtattaccggcggcgagagcaggagctagtttccatgccgccatcagcagtgggaagttccacgggataatctgtcctacaaccccaatgggttctctgatcactaggctgagagtatcggcatcaatcacatcggcttcatcggaatgggcgcgaatgacgccagcgaagtagcgaaagtgatcaacggcaaaaggaatgtcaaacgtccgacatagatttagtgtcttaccggcgtctaaggcttcaagagtaatgaaacgttctgattcagcttccagcaggtcagcgattttcagtagcagagattgtttttcggctgctgattttttactccatgcaggtaaggctttttgggcggctttgactgccagttcaacatcttgggcattgccagcagcatattctgtgagtaactcaccggttgccgggttataacttttacgggtttcttttgaaacgctatctacccattctccattaatcaacatgttatatgatttagcaggtaacatttcttttgcgatatcatgtagttttttcattatattctccgagtactttggtttttcctatgctaggacatctatcccgaatgttttatgggattaactcttatttttctgtcagaattgtatttaaatataaaggacctgtatcaataaataagtaggataataaaatagagggtgtaatctaataaaattacatgagtatatttataataaatgcatgtcataattttaaatataaattatttatcgtgttattaattaattctttttttgttatttaacttattcatctatttacatatatgataatacatatctgatatttcagcattgttattaatatgatgacttatataaaacaaaagccgttatttaatatttttatatttattataataaagtaaataatatacatatgttatatattaattaaattgttatagagtgataaatttgaattatattttatggttgctgaataataagatcattctaaaatttatttcttaattaaaagtttcaaatgattatgtaatgaaattattttatgaatatcattaaaagcccccgacatatgtcggggacttttaacatcattttcagtgagttttatttattctctggaggggacatattttttttacttgatagggaaattgatatatcttctactggattttgtctattaccatttaaagcttgatgcattttatctttatctaaagcattttcccagcgagcgacaacaatgctggcacaagcatttccaactaaattggtcaatgcgcggcattcagacataaatctatcaatgcccaaaatgagagccataccggctacgggtaaactgggaacaacagataaagtagcggctagcgtaataaagcctgcacccgttactccagcggcaccttttgagctgatcattgcgactaataataaagatatttgctccgtgaaactcaactcaattcctgttgcttgagcgataaataatgcagccatcgtcatataaatattagtaccatcaagattaaatgaataacctgttggaataactaatccgacaaccgatttctcacagcctgcattttccatttttctcatcaggctaggtaaagccgcttcagaggatgatgttcccaaaaccaaccacagttcatctttaatgtatttaattaatttaatgatggagaatccgttatacttagcaacagcccccaatacaacaaaaataaagagtaatgatgtcatgtaaaaagtgacaattaacatcattaaatttccaatggatgaaatgccatatttaccgatggtaaatgccattgccccaaatgcgccaatcggtgccagcttcatcaatatgcctaccatcttgaaaacaggctctgagaagttttgcaaaaacaccaatataggttcccccttttttcctgttgacgctaaagcgataccgaaaataacagcaataaagaggacttgcagaatattcccattcacaagtgggctaacaaccgtttccggtataatattcatgagaaagccgacgatggatgattcatgtgctttctccacataaccgatgactttgctactgtctaacgattccggtgaaatatttaagccatctccggggcgaatgatattggcagcaaccaaaccaataattaaagcaagagttgaaaacgtcaagaaatacaacatcgattttcctacgacacttccaactgatttcatattattcataccggctatccctgttacaacagtcaaaaagataacaggggcaataatcattttcacaattttgatgaaagcatcacctaagggtttgagtgattcaccaatgtctggataaaaatgacccagcgctatacccagtaagatggcaaatatgacttgaatgtaaaggacctggtataaaggttttttcttggaagtgttatccataaaggatcctgtggttaatataattatttgtttttattggtgactttttacaacgctttattgtttcatggcaaaaatgtttgatttttgctgcataaagaatcatgttgaccaatataaaaattactcctaacgcctgtcagaaacaagccctcggatctatagaaaaacccacaggaaaaacctgtaggttcagattaagacggtactatttggtcgttacccagaatacaccgctaccgtccaatgccgtaaatgttttatgaacataaatactgtctgcatggggatcaatatctttgaacaactcaggatgcagccatttagcaatggcttctacggcaatgatattgaatggtgaatcgtaatattggtggtaaatcgccatcacgcgtttttcacggtacgatctgagtactttcagatttgggcgggagagcaagttttgcaaacgcttttcggatttttccaaattgccggtataacctaaaggaaccgactggctccctgcgcgaacctgatcccaatctgctactgtcatcaggtaagtatcgggattgctgaccagcaattgctcctcgttaactttgcctcccatgcctgagaaccacttactgccgacgttatctccccctgcggttgtgacaaactctccgaagctattgtcaccaatggtatcgcagcaatcttctgctcccagcataccggcatgatactcgatgaaaacactggggatctgctcttggtacagtgtgccgatacgcttattgatcaaagacagacggctttcataaaacgcaatgtatttaccggcattttcttcttttttaaaaaccttaccaagaagctccatactgggtatggtattggacagcggatattggcgaaaatcgatgaaaatgacagaaatccccgatttttccagtaatttaaccgtattgctgttatccagtttaggcttcaggccaatatcgaaaataaccagatcaggtttataggtcatagctttttcgacactgaaatcactggtataggggttcgggaaaatagggatttcccttaattgaggaaattttttctcataggctgcggcaaggtcaggtgcttttttctccagtgcattatcccatgccacaatacctttcaatggatcgttggggtgcaggatattcaacgcaataatgatccggctatctgtcagcatgacccgttgagccggagcattaactgtgacttctcgtccagcaatatctgtgacagtaatattttctgcctgtgaatatatcggtaataacacaaataataccgatataaaatattttatggagtaatgaatgacagacattttttttccttcgcattagacgtaatatgaaaactatcgataagtccatgagtgatttatatagggaaataatgtgttttcatgggaatcacaatatctttccaattattggatgatcgcatttttaataaagactttatggttcactgttacttgtagtaatacactgaattcagttttccagtgttcttttgaaattaatgttttatgattatcaaaaatattttttgtttcacaggccatgtttttccataattcatcttccttcatcccccaatgtcaatagattaataagcctaaataatgttgtttgacaaagatagaggctgaaataatttatagtaaatttttttatatggaaattattttaattaatcaatttttttacatttctatacaatgaaaatcttattgacttgttttttgtattgaataacagccagttaagtttggcatgggatagtttcatgatgaatgatatctgccagtgattaactggttaggttttcaggagagtgtaattgattattattatctgtaatatattattttgaatagttcactatggtaaacaaaaatagataaattttataaaaaaataaattgatattttttcaagtatggcatttgtctcattccgtattgtactcaggaattttgtctggcttgaacaggtttcaaaattaataatcatggtgcagaaatacatttcgttttttgcagtaacgataaaattattaggaggatggctggcataaatgcagggtattctattattaaaaatagctgatgcagttatttttctcttttcttgatactacatttatacttacaaatagaatgaatggcgctaattgagttagcgtcaatgaaaagcaaataatattcaatttaaataggggtataactaaaaacggcttatttatttctcttctgctattattattttatcggcaataggcgggggtaatcatgaaaaatttgttggcagtgtgtttattgggctttgtattaacgggatgtgataatcacctgaaaattgatggtacaaatgaaatagctgtaaaaacatccatcgaaaaaatcagagatacgttaccggaagataaaaaattaaaatttgatgattcattgaatattgccatgaccaatagcattgattttgatgatctgtttaaagagagcgcgaatggaaatattaaacatggggatatagaaaaattggaacagaaattttttcgatcactgcacggaaaaacggcagatcaacttattgcagaagcggaaaaaattaaagcagcgaactttaccagccaatgaacttacatccaatagatttcaagttgcagcgcatactatgttagccatatctgccagcattgaaccggatttcttaggcaaaattctctgactgtggggtattggatttatcttgctccaatagttttaatctttccttgcattgctggcaaagatagcaactttttcctctgaggactttattgtgctgccgtatggtcaactcatgttgctggcagcggcaataataaataaatattttgctgcggacagaatccactgagaactgatgtgtccggcaggcagatactttaagcaccgtttccataacaaagcgccattcttttccatgaggggccaccttgccaaactgatggtaagtcaataaatgtgccagttcatgggggatcacttcatcaatgaatgactgctgattttcgatcagtagaacgggattcaggcgaatttcccaaccttgcaggcgggcgctgccggcaattgtccctctctgtcgataggtcacacagggttcaggaaatgttgtttcaaggtaatcactcgcctgtgctaatttttgccgtagagtgcgcatgacggcttgctgtagtgcgagggggactctaaccaatttcataacggcagtatacggtatggtaatttcactcatcgctcaatgaatggtgagttatgaaaaagcccgctaatatcctgcgggcttcttatgctgacagggtattatttcaatcctgccgcagaacgcagaatttctgccttgtctgttgcttcccacgggaaatgttcacgaccaaaatgaccgtatgccgcagtatcacgatagattgggtgtagcagatccaacattttgatcagaccataaggacgcagatcaaagaattcacggactaattggatcagggttgaagttggcactttttcagtaccgaacgtttctaccatgatagaagtgggttcagcaacaccgatagcgtaagacacctgaatttcacagcgatcagccaaacctgccgcaaccatgtttttggcgacgtagcgtgccgcataagctgcagaacggtcaaccttggagggatctttaccggagaatgctccgcccccgtgacgcgccataccaccgtaggtatccacgatgattttacggccagtcagaccacagtcacccattgggccaccgatcacaaagcgtcccgttgggttgatgaaatatttggtcattggagtaagccactcagccggcagtacaggcttgatgatttcatccattacggcttcttgcagttctttctgctggatatcttcagagtgttgagtagaaagcactacggcatcaatgccgacaattttgccgttgtcatactgaaaggtaacctgactttttgcgtccgggcgcagccacggcaggataccgtttttgcggacttgagcttgacgctcaaccagacggtgcgcatacgtgataggtgccggcatcagcacatcggtttcgttggtcgcataaccaaacattaacccctgatcacccgcaccttgctccaggggatctgcacggtcaacaccctgattgatatcaggagactgtttaccaattgcactaatcaccgcacatgaatttgcatcaaagcccatgtctgagctggtatagccgatttcacggacagtacggcgggtaatttcttcaatatcaacccaagcgctggtagtgatttcaccaccaaccatgaccatgccagttttaacataagtttcgcaggcaacacgagccttaggatcttgttctaagattgcatcaagaacggcatcggaaatttggtcggcaattttgtctggatgtccttctgaaacggactcagaagtaaaaagatgtgtagtcattatatttggttaccttaaatataatcttggtttaagggtagatgttttaccatctagacggccattttaaggcactcttgtcaaggataccagtttttttagttttaaaaatcttttgccgtgtgacatttttcggcgtttctaaaaaagatcagtcagagtgaatgtattctgataaatttcattttgcaattttgcctgattgcaggtataaactgcgcgcgtaactgatgggttttttgcacttcaggttatgggcgtttgcggggtacgttcactgcgtgttctgcttctcaattgagaaacggcttgcgttctgataagccatgtgggggtgaatggggttatgcaccattatctgctgattgttaacggccaacagccacattatgctattgatgtattcacatctagttcctttcttttcagtatgaactcatcccgatgttaccgaaagcattcaaacaggctggtaatatcgagtcggcaccatattgtcacaccgtaaataattgtttagttccctctaaacgtttctataatttaagggcatgctgttccctggcattttttaatgcgcaagatacgcactattagcactattaatagtgtcttgggttattgacattacaggtgaaggcaaacctctactccatgaaggagactgccatgaatgataatatcgctcgtaaaatgcgacaaacctacaatatcgcatactggggtggcggctattactatgtcaatgatctgggtaatgtcagtgtttgtccaaaccctgatttaccgggcgctcaagttgaacttactgagctggtgaagaaagttcaggaagaaaaaaaacagttgcgtttgccctcattattttgttttcctcagattctgcaacatcgtctgcgttctattaatgccgcgtttaaacgtgcacgtgaatcttatggttataagggcgattacttcctggtttatcccatcaaggtcaatcagcagcgtcgtgtgattgaatcattggcaaatgcgggtgagcccatcgggctggaagcgggctccaaggctgaattgatggctgtgttggctcatgctggcatgacacgcacggtcattgtctgtaatggctataaagatcgcgaatacattcgtctggcactgatcggtgaaaaactgggacacaaagtgtatctggttatcgagaaaatgtctgaaattgcgatggtgctggaagaagcagaacgcctcagtgtgatccctcgtcttggtgtgcgggcgcgtctggcctcgcagggggcgggcaaatggcagtccagtggtggtgaaaaatctaagtttggtcttgcggcggcacaagtactgcaattggttgaaactctgcgctcagcagggaagctggatagtttgcagctgctgcatttccatctgggttctcagcttgccaatatccgtgatgtggcaaccggcgtgcgtgaatctgcccgtttttatgtcgaactgcataaactgggtgtcaacatccaatgctttgatgttggtggtggattgggcgtcgattatgaaggcactcgctctcagtcagaatgttcagttaactacggcctgaatgaatacgcgaataacgtcatttggggaatcggtgatgcgtgtgaagagcatggtttgccgcatccaaccgtgattactgaatctggccgggcgttgactgctcatcatacggtcttgatctctaatgtcattggggtagagcataacgaatttactgaaacaacaccgccagcagaagatgcttcacgtcctctgacaagtttgtgggatacgtggcaggaaatgcaggatggcggttattctcgctccctgcgtgagtggctgcatgacagccagtttgaccttcaggatgtccatacccaatatgcacacgggatgttgaacctgtctgagcgggcttgggcagaagaactctatttaaatatctgtcgccgtattcagcgggatcttgacccaagcaaccgtgctcatcgtccgttcattgacgaattgcaggaacgtatggcggataaattctatgtgaatttctcgctgttccagtcgatgccggatgcgtgggggattgatcaggtgttccctgttctgccgattgaagggctggataagccactggatcgccgtgcagttttgttggatatcacttgtgattctgatggtatcattgaccattatgtcgatggtgatggtatagcagcaacgatgccaatgccggcttatgatccagagaatcccccattgatcggtttctttatggtcggggcgtatcaggaaattctgggtaatatgcataacctgtttggtgatacggctgccgttgatgtttacgtttcagaacacggcgaagtgacctaccagcagagcgaagagggtgattctgtagctaatatgctccaatatgtaaaactggagccgttggtactgatgagccgtttccgtgatcaggtgaaagcggctgatctggatgaaaatttgcaggagcagttcctgcaagaattcgaaaccggcctgtatggttacacctatttggaagatgagtaatcttttagcgtaatcaagttccgtgttgctgaaattcagtgaacgcggggcttttgaggatatatcatgagtattagctccttagggaaccaaattgataactctttggtttcaaatgccttcggtttcctgcgctttccgctgaatttccagccttattccagcgatgcagaatgggtgattaccggtgtgccttttgatatggcaacatctggacgtgccggcagccgtcatgggccagccgctattcgtcaggtatcgactaatctggcgtgggaaagctgtcgctggccgtgggacttcagtttgcgcaagcgcctgaatgtagtggattgcggtgatctggtctttaacttcggtgatgctcaggacatgagcgacaaattgcaggcacatgctgaaaaagtgctggcatcgggtaagaaaatgctgtctttcggcggtgatcattttgtcactttgccattactgcgcgcccatgcgaaacatttcggcaaaatggcgatgattcattttgatgcccatacggacacctacccgaatggcagtaagtttgatcatggtacgatgttttaccatgcgccaaacgaagggctgatagatcctcatcgctcggtgcaaatcggtattcgcaccgaacacgatactgacaatggttttactgtattggatgcggcacaggtcaacgatcgtagtgttgatgatgttgttgaacagatcaaaaatgttgtcggcgatctgccaatttacctgacattcgatattgattgccttgatcctgcttttgcgcccggtacagggacgccggtgattggcgggctgacgtccgatcgcgcactgaaaatcctgcgtggtctgcaacccctgaatatcgttggcatggatgtggtggaagtggctcctgcctatgatcagtctgaaatcaccgctctggcagcagcgacgattggattggaactgctgtatttgcaggcgtcgaagaaagcagtttagtttttgattaaaccatccaattgcaaagaaccccccgctggccagggtggttctttgtttcaagtagtctgaatgcctcacttattgttcccaaactgaaacaatccagtaaaaccacgaccagatattgcagctgcgaaaaactccgctaggatgtttgcaaagacattcgactgaggagacaaccgatgataatcagctcacctgaatttaagcataatgattttttgcataaatatcatgaattcaatgggtttggtgttaatggtgataaccgttcccctgagctttcttggcagaatgcacccgctgagaccaaaagtttcgctatcactgtttatgatcctgatgcgcctactggcagcggcttctggcactgggttgcttttgatatccccgctgaaacacacgctttgtcagccaatgtgggtcaggcggatggctctggtcttcctgccggcactatccaaagcagaaatgattatggtcagactggttttggtggcccttgcccgcctgaaggtgataaggcacatcgctatattttcaccatacatgctttatcggtagaaaaactggggattgatgccgaaacaacaaacgctgttgcacgttttatgattcaggctaacaccctgacgacagccactctgacaggttactatcaacgttaacttccagcgttaacggattaattaacaattttgggttccggtaaaaggtataagtatgagcaataaaaaaattgaatggaataatggattacagcaggaagcggtagagatcctttccaacgagggtggaatgatcgtctgcccgaccaaagtgggctacattattatgacttctgacgcgcaaggtctggagcgtaaattcgaagccaagcagcgtaatcgcaacaaacccggcgttgtgttatgtggatctctcgaacagttgaaagaattggctcagcttaacccggaaatcgaagaactgtatcaaaaacattgggatgcagatgtgttgctgggctgcatcctgccgtggaaagaagacgctgtcgcccgtattcctgatgatggttctaaagaactgatgatggatggccgtggcaccagttgtttcgtgattaaattcggtaaaccgggcgaaattctggcaaaagcactgtgggaaaactacgggaaattctcctttgccagctcggctaacccatctggtaaaggtaaccgtggtttggtggaatgtatcggtgaacgcattgaagagcgcgctgacttgattattgatgctaatgactatgttaaatctatccagccaaatgaaacggatcagacccgctatgagcagggtgtgatgatttcaatggtggatgacaacgggacactggtgccgatgcagaatggtcagcgcgatatcaccccgtgcccagtattgattcgtaaggggctggatgtgcataagatcatggtgataatgtctgatatcttcacaacttgggattaccgtcacggtaactattattgattactgattttttttgcgggtgcatttattgttgtggatacacccgcactgatctcccctgtctattctttccttttgatatccccaagatcaccccgcagtttctgctgcaaagcgtcggcaaatagctgcacacgtgaagaaagcgtgttttctgatttaaacatcatccaggcttggtaaatatccatattccatcccggcaatagccggacaagtttgccttctgctacagattcatgggctatgtaatctggcaggtaagcaatgcctgcaccggacagcgccgagctcatcaacgccacgctgttattgatgcgaaaacggctgcgaacttcaatatcgagcttttgcctctccttacggaacggcagggaaatcgtatgggcagggccacgaaacagcaggtaatcgtagcggggcagatcttcgggtttttctatcggcggaaactgactcatataatctggtgtagcgtaaagcccccaagtgatatcaatcaggggcatgacaagtggatgatccggtatttctcgtcccacaatgatcgcaatatcgtagttatcatctgtcatatcgatggttctgtcggttagttccagatcaacgctgacatgaatgtttctggcgataaagttattcagagcggggacgatacactgactaccaaaggataccggagcaatcaggcgcaggcttcccatcggttcgtcatgaaaatttcggataaaacgctcggcgcttttggcttcattaagaatacgggaacagtattggtaatagctcagtccgacttccgtcacttgaattttgcgcgtggtgcgattgagtagctgagtgcccaatcttacttctagctgtgcgatctcgcggctgacagaagatttagatagccttaacgatttcgccgcttcagtaaagctcagtgtctctactacgcgggcaaaaatcaccatcgaagtaagattttcaatattattcatgaaatagcctgatgatttacttgggggaatctccgcctaacataccacagatgttatggagaaaggccaatattcctctatcagatgaaggtgatattttaaccaaagattaaactgcgctgcaaaaatggtgtcagaataagagtgcaggaatttcccctctgaagaacaactgttccaatagagaaacagtgcgtccaacaatggtatttccctgctataagcgttagtaatgtcgttaagacttctatttttttactattttttaatctttcggaggcaatgtgagatgagccaaactatgacacaaaagattctcgcacgagctagtggccgtgagcaggtcacaccgggtgaagtggtttgggcgaaagtggatatcctgatgtctcacgatccctgtacaccgggagtagccagtgtatttaaaaaagagttcggtcaagatgccaaaatatgggacccggctcgctttattctgatccccgaccattttgtctattctgctgacccgcaggccaatcaaaatattcgtgtcatgcgcgaatttgctgccgagcagaacattaaatatttctatgatgtgggaacaccaaactataaaggggtttgtcatatcggtttggcggaaggagggcatactcgccccggtgaagtcctgttggggacagattctcataccgtcacggcgggggctttcggcgcgttcgccattggactgggcattaccgatgccgcctatgcgttaggtacaggggaaatccccctcaaagttccgacttctatcaaagtgaattttaccggaaccaagccctcgcatgtgttggccaaggatatgattctggcggtattgtcagaattaacggttgatggtgcaacttatgaagccattgagtttagcggtaatgtcattgatgaattatcggtagaagaacgcatgacgatttgcaatatggtcgttgagtgcggagccaagaatggcattatggtgcctaatcaggccacctttgattatctggctgagagaaaccaccttccctttgagattgtttatcctgacgaagatgcggaatatagccgggtgttaaacattgatgtttccgatatgcagccgatgattgccaaacctcattctccggataatgtcgttccgattgagaaagtgaccaacgttgctatttctcaggcttatatcggctcctgtaccggcggtaaactggaagattttattgcggccgctcgtgtcatcaagggcaataaagtctccattcctacttatgccgtccctgctaccaaagaagtttttcataagacaataaccacccagattgatggtgtttctgtttatcagatcttaactgacgccggagtgacactttcctcggaatcaggatgtgcggcttgctgtggtggcccgccagatacctttggccgcgtgaatgacccgatatcggtcatctctacaaccaatcgtaattttgtcgggcgaatggggcataaacgtgccaatatctatctggcatcaccttactcggtagctgccgccgccattacagggcgtattaccaatccgggggagtttttatgagtatattgcaggaaaacatcatcagaggcacagtttatgtcttgactgacaatatcgataccgatcagatcctgacggctgaatatctcaaggtaaacccctcaacgccggaaggatacgctcaactggcttcattagcgatgtgtggattaccggaaggctcgctgccctttattgatgaagaacagggcaaagcaaagtacccgattattgtggcagggcagaactttggttgtggttcttcgcgtgaacatgcagttgctgcactaggggcttctggtgtgaaggctgtcttagcacagtcttatgcgcgtatctttttccgtaattgcgtttcgaccggagagttgttgcctgttgctgcacaggaacgcttgtgtgacaaattagtcactggcgaccgtattgagattgatattgaaaaccagacagtgactttgctggcaaacagtgaaaaatatcccaccgatccggttggcgaactggcgaatattgtcgcggcgggtgggttattctcttatgctcggatgacaggcaggataaaataaagcgttgtctatgcaaaaaccactgtggctagcggtggtttttggcattatagcgttcccataaacgtttcaacgggaaccccaaaaaatttagcaaaccctttcacttgttgaattgtcattgaacgctttccgtgaaggatctctgatatcacactttgagtggcaatatcacacagatcagcttgcctgatcctccgttctttcataaaaaaagccagtgcttcacgcgggctgacgttagatacattccggtttttggtttcatattcataaatgcgatctgtgacaaaatcggcgaatttggctgctacatgctcagtatcatcggcatatgaatacaattcatcaattatgaccatccgagctttaagatcttcttcgttctctacgggttcaaggcaggcggaaaataaaagggcaagagggctgagttgatcagatactgactgcatcatttgcggtaatttcttgatgatcccatcaatttcttcataaacgagtaatgcttgtctcatgatttacctttttggcctgtttgatttggtttgttcacgccaccatctatcgtatttagcatgggagcaaacatctttaatataaaaagtaccggatttggggttaagccatgcaattatcctgcatttatttttatgaatatcaaatatataaatatcaagcggccccttctgattccctgcctccaatagctcatgaggtatacgatcaacgttccatgcagatgtttgaagccagagatcacgtatctgggcataagattcaaaccgcaaagctgctttatcaaaaacatccagccatagctttaacccaactttccattgagcatgtttcctcattgcttcaatgatgactcgtgcagtgataactcgcataccgctcccttataatatcgcaatttgcgatattggcaagatttgaaaaaacgtcagagtcccttctgtttgtgagcaaagaatatcactcgataatatacgtcaacactcgttgctgtagtatcagtgtcaaattgtcataaaattgcgagccagcttgatatttatcaggtaatgtttgcagcagcttcatgctcactatgtgattacgacaatcaaaggaatggataattgatagtagcaagcatccatgaaataaatattatttaatataaataggaattttctttttgagtgggatgctaatttagatcatattaatatgtcgaaactggatgataagattaaccaagtagctaaatcaaatctaattatagaagtcaggcatagaggcagtattagcctgccagattaaatccagcgataagatgccagccaaacactaactggcatatctcactaacccttaaccaatcaaatacgtcagcacctgccgctgtggcatcaacacaaaattcccatgaaattgcgagccagcctgatattcatcagataacgttttcagcagtttgatgctcaatgtgtgatgactgcaatcaatggctgtaatttcagcggcatgaaaatcaaaaaagcgttttacatggggatagagcgctttgaaaaggctctctttgatggaaaaggtaagggtgaatgcttgagcgaaagagagtgtacattctttcagcaattcggcttcggtttcattaatgacagtgcgtgaaacactatcgatagtatcctgtttaatttcttgttcgatatccaccccaattatctgatatttctcgcgggaagcggcaaaaacaatggcgcagttggcggagtgcgacagggagccgcaaatcttatcaggccagacaggagagcgatctggcgcatttatgacctgaaattcaggatagtccatgctatttaagatctgttgagtgcagtagcgagccgccagatattcagctttccgcttgtttactgcgttctgtagccttgctggataggtaataccgtacttatcaaataaaatatcctgatagcaagcctgatcataataagtttgcattacctgaatatcagggtatttgggtaagttgcctctctgaatgacggtgaagaagggatcatcgatggcagtggttttaactggggtaaaagtaatttctttcatgatcaatagaatattatgggtgagttattatctattaattttgccatactttagcgcttgttcactaacttactgactctttttatactctttcttgttatcatttttattgtgtgaaacagtgacactaacagaaactggcacgtggaagaatgtgatatcgtgtttatcgaatctttgcatgagtcaatcagattgagaaagaggttaatgtggaaatattagtgacaggtggaatgggatatatcggcagtcatacttgtgttcagatgatggaagcgggaatgacgccgatcattatcgataacctgtgcaatgccaatcgcgaagtattggcgcgcattgcgacattgacgggtgtgatacccctgttttatgaaggggatattcgtgatgaatcattcctcgatactattttttcccgccatcaaattcagtcggtgattcattttgcaggtttgaaggcggttggggaatccgtcgctaaacctattgaatactatgataacaatgtcaatggcacgctggtgctgatgcgcagcatgcataaagcgggcgtaaaaagcattattttcagttcatcagcaacggtgtatggcgatccggagatcgttccaattacagagcaatccgccgtagggaataccactaacccttatggcaccagcaagtatatggttgagcgctgtctgtctgatcttcatcacgccgaaagtgattggtcggtagtattgttacgttactttaatccggttggtgcacatccttctggcactatgggcgaagatccgcagggcattcctaataatttgctgccatacattgctcaagtggcagtaggccgcagagaaaagctgtccgtttatggcagtgattactcaacgcatgacggtacaggcgttcgcgattatatccatgttatggatttggctgatgggcatattgcggcactgaatgccgttggcaagaaatcaggtctgcacatctacaatctgggaaccggaaaagggactagcgtattggaaatggtcacggcatttagccacgcttgtggcaaacctgttccttatgaaatttgtccgcgtcgtccgggtgatattgccgaatgttggtcaagcccagaaaaagcggaacgtgagctgggctggaaagccagccgcactcttgttgaaatgacggctgatgcatggcgctggcaatctcaaaaccctaatggttatacccaataggcttcaaaagggaatccctctcctgagtcacgtcagcgtgaaggtgggggaggatggttaaacagatactgtgaatttctgcattattacctatttctttaccgactgttgttatccatcgcaataagaggagtatggtcatgagttctaacccgcagcaagaaactaacccgcagcagtggactgccgttgatcattatctcaaaaaaagtttattaaaatcggcaccgcatctcgaaaagacactcgaatataatgtcagccaagaattgcctgccattgatgtttccccgcttatggggcagtttttaaggatgatggtgcagatcagcggagcaaaacgtattctcgaaatcggcacgttgggcggttacagttcccaatgtatggctaaggaattaccggatgacgggctacttgtcacattggaaaaagaacccagaatggctcaagttgcgcagcataatatcgaccaggcgcagcttgcacacaaaataaagattattgtgggagatgctcgtgaaaccttgccgacgctggtcactgagccattttttgatctgatttttattgatgcggataagcaaagcagtgaattgtatctcgattgggccattaagctgggacatccgggaagtattatcatcatggacaatgttgttcgtgccggggctattttgcatcagcagcgtgatgagcaggttgaaggtatgcgtaagtcgttggataccatgcttaaccgtcctgaaatcacagtaacggctttacagacagtcggtgaaaaaggttgggatggctttgcgttattacggataaacacggaaaatcattaagctgtaatgccctcgatttttcggatagttatctgtgcataaacattgaagatgagtattaaggtttacaaaaaggatggcttatttaaatcataaaccatcctttaaaataataaatgagcatggagtctttaataagactgataattaatcgatagtttctaaagaacaactcattaaataaaacgtaatattattgttttttgaccgcagttttttcagatttacgggctaactgacaggctttacgttcatcaggctctcggtctttaatcacttttgctgtttcatccacggtagggagggaaaaacccatatcatcataagcaccaaaaccaatcaggcgatagccacttagttgggtatttacgggaatgcggaattcttttttctctcccggcgccagtgattcaaatgattgtactgtcggagcctgaggttcacatttggtattcagaggtaaaaccgccagatagcctcctgctacaggtttatcgcctttattttccagcgtgccccctacaaagaatttgccattggctcccaaccccatgtggaacaacaggtgtgcttcgcctttcgcccataaggcagagctaaacaggctacccgccagtaacatcgcaccgtatgtgtaactacgccatttcatttttattctcctattgagtgaattcctaacatgaaataggtattgcagtggttagaaaaaaaatcaagttaatctggctgatatcaatttgtatatcgggttatttattcatatttacacaatgacgactagctgcgccattacctgttgtaactcgtgtgaattcatctggatctaatatagcaatgtagctggttaaatagtggttgcaacctatgctgtcagctatgctcagggcttccggagaattaaggagggtgatcttaggtagtgatttatattcgtagtcccattgctgagaaatatcaagtccctgaaaatcaggcggtaaattgggaacgatatcttttgcatagttgaatacttcatagtggctaaaattattatcaacatattcaacaaattcattatttccgggtctcgggcaagcaaacaaacaggcagaatgattgggtgctaaaaaagcgatatcacacatcaaataagaagcgatggcggctccaagactatgagcgagtattgtgaattggccgtttatgcctatgatttgagtaatcgcatcggccagttttagttggctataatcgcaatcacattcagaattaaacgcaatgagtttcagtgagtcgtaaacgctataaaaaccgcggcttactttccgttctggggcactagaccaaggcgatgtaaaaatggcaatgatatcatggagatcctccagaaggtttgtgtcatccgttcctcggaatataatgacatactttcccggtgcgtccttcttctctgcaatatatccgtaacagatactcttcggcaatgtgaacaacatttttttttctactgagaaagaggtgtcatctccggaaatataagcgataagattccatccatcctctttgatacgtggatcagcagggggagtgggattattgtaatatttttcattcatatcatatgcgtacatgattaatgatgccaattttgctgcttcagtgtgcgtatacataacatatctcctctgtattatagaaaaagtcgaaagatgatatttcatcttgaagaaattgtagggaatttgggcgtgtagtgtagaattttagagcgccattgatgatctattgatgttaaagaaatacccttttcatcgggttggccaggtatttagtaaaaataacgacctatctattaatatagaattaatcacattttgttatatatagtttttatttgttcttttaaattcattgccatgcagcgttattctttaccaatctgaaagttttagtttgcaaatatcactgattatcaagaggctaatatggctgtaccacgttcggttcttgaactgattgggaatactccgctactggagctgacccatctggatactggcctatgccagttgtttatcaagttggagaaccaaaatccgggtggctctattaaagaccgagtagctctttcaatgattgaaaaggctgaaaagcagggattgttgcagccaggtggaaccatcattgaagcgacagccggtaataccggtatcgggctggcgctggtcgctgctatgaaaggctataaactgattctggttgtgcctgataagatgagccgagaaaaaatttatcacttgcgggcattgggaacggatgtgcgtctgacccgttctgatgttggcaaggggcatcctgagtattatcaggactacgcgctgcgtttgtcgaagcaaatcagtggcgcctattatatcgatcagttcaacaattcctcgaattcactggctcatgcgacgacgacaggccccgaaatctggcaacagatggagcataacgtggatgctgtggtggttggtgtgggttctggcggtacgcttggcggtttgagccaatacttcagggaagtctcccccgatacggaatttgttctcgctgatccgaaagggtcaattctggcagattatgttgagcacggccgttacgatgaagccggaagttggtttgttgaaggtattggcgaagattttatcccgccgctcggggatttttctcaagttcagaatgcctatcggattactgattcagaagccttttccagcgccagagatttgctcctgcaagagggcattctggcgggttcatcttcaggaactttactggccgccgctctacgttattgccgcgcccagaagacgccaaaacgggtggtgacgttagcctgtgacagcggtaacaaatatctgtcgaagatgtttaatgattactggttattggagcaagggttacgttcacagccacaagagaacgatttgagtgattacgtcacttatcgttatcgggatggtgcaaccgtttcagtttcgccgcaggatactctgcaaatcgctcatggccgaatgcgcctgtatgacatttcgcagttacctgtgctcgaaaatgaacaggttgtgggcatcattgatgaatgggatttaatgcatgccattcactcagattctaataatttctctttgccagtcagcaaggcaatgacgggtcaggttaataccctcaataaaaaggctccactggagcagttgactgcaacttttgatgcgggtcatgtggctttgattgtggatgataacaatcgttttctgggtctggttacccgtactgacgtgctgaatgcatggcgccaacaactcaattgaattctcaggaataatttaatgactacaactaagtttgatacaaaaagcgttcatgcaggctatgtccccgatcataccggcgccgtcatgcccgctatttatgccacttccacttatgcacaacctgctcccggccagcatacaggctatgagtactctcgcagtggtaacccaacccgcgatgctctggaacgtgcaattgctgaattggagaacggtactcgtggctatgcttttggttcagggctggccgccagttctaccattttggagctactggataaagacagtcacattattgccgtagatgatctgtatggcgggacttaccgattattggaaaaagtccgtcgccggacggctggcctgcgtgttacgtatgttgaagcggggaataccgcagcgctggaagccgccattgagcctgatacaaaaatgatttgggtggagacaccaaccaatccactgctgaaactggctgatctggctgccattgcccagatcgcccagcgccataagattatcagcgtggcggataatacttttgcatctccctatatccagcgtcctcttgatttaggttttgacattgttgttcattcagcaaccaaatacctgaatggtcattccgatgttgtcgcgggtcttgccgtggtggggaacaatgctgaactggcggaacaggttgcttttctgcaaaattccattggtggcattctcgatcctttcagcagtttccttgtcctgcgtggaatacggacgctggcgctgcgtatggagcggcatatcgataatgcagagaagatggcacattggctggagcagcaacctcaaatagagaaagtgttttatccgggtctggcttcccatcctcagcatgaattggcgaaacgtcagatgcagggttttggtggcatgatttccgtggtgttgaaaggcgatgatgactatatacgccgagtgattaaggaactgaaattatttacgttggcagaaagtctgggtggagtagaaagtttgattggccagccatttacgatgacccatgcctcgattccactggaaaagcgtctggcatcaggtatcacaccccaattgatccgtatttcagtcggtattgaaaattcagaagatttgattgctgattttgctcaggcgttagaaaaagccagcctgtaacaaaaataagataatgaaaaacagaatgccagctgttcttcctcggttggcatttttgtgctgctcttttttagcgattgtcttattgccttctgctgtaaattatccctaaatatctacttgaggataaggtattattcctgctgaataaggcaaaaaactgacgtcagatacccagtgaaaagaggatgatgtgttatggcaattttaaatatactcacgatccctgatgaaagattgagacaaaaatgtgttgatgtcacgcatgttgatgaaatacaaacattgattgatgacatgctggatacaatgtatgacacagataatggcattggtttggctgcaccgcaggttggccgaaaagaagcggttctgatcattgatatctcacccaatcgggatcagccgatggtgttagtcaatcccaagattgttgaaaaagagcgtcgggtcgtgaatcaagaaggatgtctgtctataccgggatattacgcggatgtagaaagatttgaaaaagtgaaagtggaagcactggatcgtcatggcaagtctattacggtggaaagtgaagattttctatcgattgttatgcaacatgaaattgatcatttgaatggcattatttttattgattatttgtcacccttgaaaaggcagatggcgctgaaaaaagtaaagaaatttttgagtaataaggcaagttagctatataacgggaaagaaaaatatcaccattcgtttcatggtaatattattccttcactcaatattttaattttatatatcagagttatttaaattattaatgataaataaaaataaaaaagatacaaatttatttataaataataattatgcggatttaagtacggaattttgtgctgttttaaattatagtgggcaatgtttatctacctgaattttaataaaattatagttaatgatataaaagagggaatgattgtggctggaaaaaatgatattacattttatcaacaatccaattttactatcagcttgagtttgatagatacaactgatgctaagattggcgcctatttgatgatacttgatgctgaaggaatcaataacgcgcaggttttctcgattaaaagtggaagtgaaatggaatatgttcacattccatcaacagccagcagtaaccaacttacatgctccatttatatcaaaaaagtggacaatggcagttatccgctggttggcactttctatcttcgctatcatccagcatctgggattgttgatattaccgaagtgaaaatatcgccgggagccctgttgaatttggaagtagacaaagtcgataacactaaatttcactttaaactgcaagcgaagcaatgcaatcaggctattacgtcaatataatgaattaggcaatggatgaatgtccatcaaaaacggatgcgatatacgcattgttttcataagaaaaaataacgagccagcaagggggctgtgaagttttttttcaaataaaaaccgcggggaagtgtcatgatgggttgaccaaattctccaatcgcttctgtcaacgctcggctattggcggcttttggacgtaattgcaacacttctccgtgacgtgcggtgatattctcaactttgcccaatacgatcaaatccattaattcttcccaatcacgtcgcaatagctcttcttcaatcggatcggggctccagagcagtggtgaaccgacacggcgttcggcaagtgggatttccctttccccttcaacaggtatccacaggacacgcgataatttacgcttgacgtggcaattttcccatctaatgccactattgcccgttaaaggtgcaacgcagacaaaggttgtttccagtggtgaacctttcttatctacagggatggtttttagttcaatgccaatatgttcgaaatcttgttctggtttactgcctgcacttgcgcccaaataatactcaagcaacatgccaacccaacctttatcccgttttagatcgggaggaatgggcagattggcctgcgcagctagctcacccattgacaaacccgccagagaattagctcgttcgagtagttgttgttcattttcaggtggactgggcggtgtaaagtacatgtttatcgcatatatttttgatggttaaaaaatgttcagtatgattatgggaaatcattatgaacttatcattatgatgattgccttgataatagcatgatatgcaagattttttaattggtgttcaccgtattaaaaatagtcttgttatgattgttcacctattcccagcgataataaacaggatcttacactatgttatccacagatttctgggataagtgataaaaattgagatcactggtttgatttacagctctgttaacccttgttttctacaaaaatagacgatttttgcttaactaaaaggcatatcctgtggataaaatcatcattgattgatatttgctcagtgtgaacagaataggaaattatgatgactgatatcgcttgtgaaaaagagaataaaatgcattaagataatgaaaaataataaatatttatttaagtttatgacgcgttataaaatatgaaagaaaaatatacccgtcttacccctgtctttttcacatacatatccacagaaaaagtgaataaaatagtggccgtcagactaaaaatgtttataactttagctttttctgtgaattatccttgcggcggtgtaaaccacgcagatttaaagtcaaaccatccgaacgtgttcatttttactcccctcatgctacgctgcacctgaatttttttaacaaaggtattttatagtaggatgaaatgatggcacctcatcctactcgatatagataggtagtgtctgctttcaacgcagaaatgcaggttgatgctgtaatgcctgtccgatgttatcgaatctatttaccatgcagtggcgcaaagtgttggcgccttaaatttcttctgcaatataacgtgcaatgatatcgcccatttcatcggtactgactgctttgtcattacctgctaaatctgttgtgcgataaccttgctccagtgcatggttaatggcttgctcaatggcgtctgcggcatcatcacgctcaaaactgtaacgcagtaacagcgcgatagataaaatctgagcgatggggttggcaatgtttttgcctgcaatgtcaggtgctgatcctcccgctggctcatataagccaaaccctttttcattcaggctggcggaaggtagcatccccattgaacccgtgatcatggcgcattcgtcggataaaatatcaccaaaaatattggagcatagcagaacatcgaactgagccggatttttgatcaattgcatggtgggcgttgtcgatatacatgtgctggatttcaacatcagggtaagctttcgcgacttcgctgacgacttcacgccacagtacagaactctgcaaaacgttcgctttatcaatggatgtaactttatgacgacgtttgcgggcggattcaaaagcgatacgggcgatccgttctatctcgaaacgatggtagatttcggtatcaaaagcccgctcatattttccttttccttcccgtcccttgggttgaccaaaatagatgccacccgtcagttcacgaacacataaaatgtcaaaacctctctccgcgatatcttggcgaagtgggcaaaaagattccaaacccgcatataagcgcgccgggcgtaaattgctgaacagtttgaagtgcttgcgcagtggcagcaacgcaccacgctccggctgttctgcggggggcaaatgttcccatttggggccgccaacggaaccaaatagaagtgcgtcggctttttcgcaaccggcgatggttgtttcaggcaacgggcaaccatgatgatcaatcgcaatgccccctatgtcatattcgctggttgtaatgtggaggttaaagcgccggcggattgcatccaacactttataggcttgtttcatgacttcggggccaataccgtcaccaggcaaaaccgcaatgtgataactgccagacttttgtttgtgtgtagtagggtggtttgacattgttatgcagtttcctttgtattgttattggggaaattgttttgggaggtattgctttgtatgcgctgtttttctttttcgacttgttctgcctgccagatgctattcagaatggggatcatggctttggcggaggattcaatgatatctgtttccaatcccatgccgtggaaacggcgcccagaatgttccacgataatattgacctgaccgagagcatctttcccatgtcctttgccagtcaactggtaggagataagttcgagtgaatatccggtaatgcggttgatggcttgatagatcgcatcaacagtcccattgcctgtagcggcttcagatttgatttcatccccgcaggccagacgcacggtcgccgttggaacgatgttggtgccggactgggtgctgaaataatccagacggtaatgttcattctcttgttgttgttgattgatgaacaccagtgcttccagatcgtaatcaaacacctggccttttttgtctgccagacgcaggaaagctttatacagggtatccagattataatcctgctcctgatagcccatttcagacatccggtgttttacggcggcacggccagagcgggaagtcaggttcaattgggtatctttcagcccgatggattccggcgtcatgatttcgtaggtttcgcggtttttcaggacgccatcctgatgaatgcctgatgagtgagcaaaggcattactgccgacaatcgctttattggccggaatcggggtattacagatttggctgaccaattggctggtgcggtaaatttctttgtggttgatattagtgtgaacacctaatatttgttggcgagttttgattgccatgatcacttcttccagcgaacagttccccgcgcgttctcctaagccgttgatggtgccttcaatctgacgggctccggcctgaaccgctgtaatcgagttcgccacggacatgcccaaatcatcatggcaatggacagaaataatcgctttatcaatattgggtactcgatcaaataaattttggataatgccgccaaattgataaggcgtggtatagccaacggtatcgggaatattaattgtggttgcgcccgctttgattgcctgttcaacaatgtgacataagttgtcgatattcgaacggccggcatcttcgcaggaaaattcaatatcgtcggtgtacttgcgagcacgcttgatggaacgaacggccatttcgacaacatcgtcaaattcttttttcaatttatgttcgacgtgcaggctggaggtcgccaaaaacaggtgcaggcggaaggcttccgcgactttcagggcttcggcggcaacatcaatatcattatcaacacaacgggataatgcacagatacggctgttcttgatctcacgggcgatggtttgaaccgactcaaaatctcctggggaagaaacggggaaccccgcctcaataatatccaccccgagtctttccagtgcataagcgatttgcagcttttcttttacactcaggctggcctgtaatgcctgctcgccatcgcgcagtgtggtatcgaagataataacttgctggctcatgttgtgctcctatcaatagattattgtgtttgattcttgagcgccgagccggtataaaaaaaccgcgctcggcgcggtttttttcacatctgatggaggttaactctgtctttcccctaccagcataccgcgcacattaaaggcgatgagtagtaggcttagtaggcgaatagtgtgaatcatgtaagctaacctttataaatctgttaatcgagtatgacgacctaaggacttttattgatacgttatcttcaaaacaatgtcaagcgacacaaatatgagtcaagagtgaatgatactcacctttggttatttactgagctacttttagttttggtgactattttttacatttttagcaatgtttttatctattatttgtatctatatatgaagtaaaattcggctctaatggataataaatagggtatctgttattttatacagttgttttgtgcaaatgttcactgatggattaacagacagggatgagatggatgttcaccgcagtgtttctaggctaagaaaacataaccatatagaatattaataagatgtacctcaatatattggaagaactgatttttggttaatatagcctgataatttttctgatagatagaaggaacaccattattttattatgaattgtttctactcgtcattctgacattattggttgcgcatttttacgcgtaagtgactaatgtaattcgagttatttctattcatacataaagtattaatattcatgcttataagaatattatcgtcgtataaataagaatgcattggttatgcatatttatttttgtacaaggaaggatctcaatttaatttctaacaaattggggtgattgatcttattaattggtatggcggtttactgtgtcaaaatgttgcattgggacactgccaatattccgttatttaatgaggtcgctgcaataaatttagtggagtgaaataatgactggatataattcagtaacgacaagaagaaaagaatcatgtgaagtgcaattgcgcagtgtggatctcaatttgcttactgtgtttgatgctgtaatgcaaatgcagaacattacacgtgcggctcaggcactgggaatgtcacaaccggctgtcagtaatgcggtagctcgcttaaaaactatgtttgatgatgagttgtttgtgcgctatggccgtggcattcaaccaacggcaagagcaaaacagctctttgggccactcagacaggcacttcaaattgtccataatgagttgcctggcgtggggtttgagcccgataatagtgcgagggtatttaacctctctatttgcagcccgcttgatattcgtttagctgcccaaattgttggggaaataaaaaaacattcgccaaatattgaagttgtcattaaaacacaaatcaatggcaatattgagaaacaattaaaatatcaggaaatagaattcgttatcagttatatacaattagatcagcctgattttcataattctccattgtttaatgatgaattggttttggccgtttccaaaacgcatcctcgaatcggtaaacgcattaatcagcagcaattgcaggaagagaggcatgcaattgtggcattggataatgtggattcattcagtaaaccttactatgaaagtaatgaattgttgcgttctgtttcttatcagggtacggatttaaatagtgttctcaatatcgtgtctcagacgtatttagtcgctattgcaccgaaatggatggttgagcattattctgaacagttaaatatacgtgcgatacctttgcccaacggtcgaatctcccgcccctgctatttgatatggcacggttcgacaaacagagataaaggtcatcagtggatgaaatcgttactgagcaatcttggtgaacaggaatagaacaaaatgcacgacgctgccagaatttgtttcatcaggtgtcattttgtctgacgtcatggtaacaagcattattattgcaaataattaagattatctaatggaactgattgtcggagagcgtgtgcggtcttactgttctgcctttatgacgatatttatctctatttatccctagctatccgataaatcctgtaaaacttccccccttaggggggagaagagagtaaaaatacgctttccccttctaccaggaataggtagactgcgcgaaaatagcgaacacctgtaagctgaaaagcagtcagtgtgcttgctgagtatgataaacctaagacttatacaggaatatatcgtgataacagattccctgcattcctatcacctgatcaaccggttgcagcagcaaaccattgaatatcccgaaaaaattgcattcaggcaatggtcaccatcagagcagcttgaaatgagttggcaagacgttacttatagaacggaatccatcgcaaaagctttgttgtcactgggtatagaaattcaggagaaagtcgctatttttgcgcataactgtattgcatggtcattggctgatttggccgttcttcagttacgtgcggttacagtccctctttatgcgaccagcagccgtgatcaggctaccttcattcttaaggatgccggtgtgcgggtactgtttgttggtgagcaagaacaatataatgttgcgatgacattgctggaattgtgccctcaactcaatcatcttattgtgctggacgagtccgttgacttaaagggctgtccgcaggcgcagcatttatctgccttcattgccaatgaccatacacaatatcagccagagcttgataaccgcattgcagggcaggatttaaatgatcttttcaccttgatctacacctccggtacaacgggagagccaaaaggagtgatgttggattaccgcaatatcgcttcgcagctttacttgcatgatcagcgtctgacactgaccagagaggatgtatcacttagttttttaccgttgtcccatatcttcgagcgcgcatggagttactatgtcatgcatacaggagcgcttaatgtctatttaactgacaccaattctgtgcgtgaggcgatggctgaagtacgtccaacggttatgtgcgctgttccccgtttttatgaaaaagtgcatagtgcaattcttgagaaagtttcccgtgcgccatttttgcgccggatgattttccgctgggcgataaagcgaggagaaagccgctggatgcgtcagctacagaataaaaaagcgtgtctcttctctctctgtagtgatcaactggccgacaaactggtgttgagcaagttccgtaacatattgggaggacgagtgcgtttcttacccgtggcaggagcacgccttgacgattctattgcccggtttttcctgtccgccggcattaatatcaaatatggttacggcatgacagaaacttgtgccacggtgtcttgctgggaagagaaaaactatcttccaggctcgattggtacaccattgccgagcattgatgtgcgcatcagtgccgaagatgaaattcaggtacgtggccctattgtgatgaaaggctatttcaaccggccggaagaaacggttcatgcttttaccgaagatggctggctacgtacaggggatgcaggggggttggatgaaacaggcaatttgttcatcactgagcgcctgaaagatttgatgaaaacctcgacgggaaaatacattgctccgcaaatgcttgaggggactttgggacaggatcgtttcattgaatatattgcggttattgccgattcccgtaattttgtttctgcgttgattgtccccagttatgacgcattagaagattacgcaaaatctatccatcttcattatcgtgaccgtgttgagttgctgaacaatcgtcagatcatcgaactgtttgaacaacgtttggtggaactgcaaaaaaatattgccaaataccatcaggtaaaacgctttatcctgctgccagaagccttctccatggaaaaaggcgaattgactcctacactgaaactgcgccgtaaggtgatttcgcaacattatcacgatgaaatcgaatccatgtatcgagattaatgttctcagtatgtgaattgatgtttgctaacgttggtgtctaacgttatgttaattaatctagtgttattgaatgagctaacactagattgactttatataaataaaaagtggaataaataaggttgtttttaatggcgattttatgaagttccgacgattaacttgcaaacagagcctggaggcaaactcaatggagatgttgtcaggagccgaaatggtcgtcagatcgttaatcgatcaaggcgttaaacatgtattcggttatccgggtggggcagtattggatatttacgatgccctgcatacggtgggaggaattgaacatattctcgttcgtcatgaacagggtgctgttcatatggcggatgggtattcccgttcaacgggaaaagccggggttgttctggtgacatccgggccaggagcaaccaatgctatcacgggaattgcaacggcttacatggattcaatcccaatggtggtgttgtctggccaagttgccagctctttgataggtaatgacgcgtttcaggaatgcgatatggtgggaatttcccgtcctatcgttaaacatagttttctggtgaaaaaagcagaagatattccaaatacgattaagaaagccttctatttggcgacaactggccgtcctggtccggttgttatcgattttcccaaagataccgtcaatccggcactgaagtttccgtatgtttatccggaaaaaatcagcatgcgttcttacaaccccaccgttcaggggcataaagggcagattaaacgggcgttgaaaactctgctggatgcgaaaaagccggtgatctacgtaggtggcggcgccatcaattcggcatgctcatcagagttgctgaaattggctgaacgtttgcacattccggtcgtcagttcgttgatggggctgggcgcttttcctgccacccatcgtcaaagtctgggaatgctgggaatgcatggcacgttcgaagccaataaagcgatgcacaattctgatttgatttttgcagtgggtgtgcgttttgatgatcgcacaaccaataatctggaaaaatattgtccagaagccattgtactgcacattgatatcgatccggcctctatttcaaaaactgtgtcggcggatattcccatcgttggggatgccaaacagatactcggccaaatgctggaattgatgaatactctggaagacactcaggacccggatgcattgaaagactggtggctttccatcgaacaatggcgtagccgcaaatgccttggttacgatcgcaccaccgcgaaaatcaagccacaggccgtgattgaaacgctttaccgtctgactgaaggcaaggcgtatctctcgtcagatgtaggccagcatcagatgtttgccgcactgtattatccctttgatgagccgaggcgttggatcaactctggtggtttgggtacgatgggatttggcttgccagccgcgcttggggtgaagctggcaaaacctgatgcgacagtcgtgtgcgtgacaggagatggcagtatccagatgaatattcaggaattatccactgcattgcagtatggcttgcctgttctggtgctgaatttgaacaaccgttttctgggtatggtgaaacagtggcaggacatgatttacgcgggtcgtcattctcaatcctatatggaatcgctgcctgattttgtcaaattggcagaggcttatggtcatattggtgtttctatccaaacctacgaagagctggaaaataaactggctcaggctctgcatgaagtcactgaaaaccagcggctggttttcgttgatgtcaccgttgatgaaacagaacacgtttatccaatgcaaatcaggggtggagcaatggatgaaatgtggttaagcaaaacagagaggacctgatcatgcgccggattttgtctgtattacttgaaaacgaatcgggagcgttatcccgcgtagttggcctgttttctcaacgtggctataacattgaaagcctgaccgtcgcccctacggaagatccaacgctgtcacgcatgactatccagaccaagggtgatgctaaggtattagagcaaattgagaaacaactgcataagctggtggatgttctgcgggtcagtgaattgaccgcaggtgctcatgttgaacgtgagatcatgctggtgaaattgcaggccagtggctatggtcgggaagaaatcaagcgcagtacggatatattccgtgggcagatcgttgatgtgacgtcaacactttacaccgtccaattggcaggaacgagtgaaaaactggatgcgtttcttgatgccgtgcgcgatgtggctgagatcctggaagtagcacgatcaggtattgttggcatcgctcgtggggataaaattatgcgatgaaaaatcgcaatctgcgggttaatatacagatacttaacgagccctactgtaaagtagggctttttcatcatcttactgaggggttaatgtgaaactggatgagatcgcccgcttagcaggggtttcacgtactacggccagttatgtgatcaatggtaaagccaagcagtatcgggtcagcgataaaacagtagaaaaagtgatggcggtggtcaaagagcacaattaccatcctaatgctgttgccgccggtcttcgggcggggcgtactcgttcaattggcttagtgataccggatttggaaaacacgagctatacccgaattgctaactatcttgagcgtcaggcacggcaacgtggataccagctattgatcgcatgttctgaagatcagccagataacgaaatgcgctgtgttgagcatcttctgcaacggcaggttgatgccattattgtttccactgctttgcctcctgaacatcctttctatcagcgttggacaaaccgttcactgccaattattgcgcttgatcgtgcattggacagcgaacactttatcagcgttgtgggggatgacttcgaagatgcgaaaatgctggcacaggagctgcgtcaatttccgtcagaatctgttctttatctgggagcattgcctgaattatcggttagtttcttacgtgaacaggggtttcgtgaagcatgggaaagtgatcagcgtgaagtgaactacctgtatgcgaacagttatgaacgtgacgcagcggctgaagtctttgcttcatggctggaaaaccatcctgtacctcaagtactctacacaacctcatttgccttgctgcaaggcgtcatggataccctccttaagcgcagtggccggttacctgagcagttggtcattgccacgtttggtgatcatgaattacttgatttccttgaatgtccggtgctgtccgtcgcacaacgccaccgtgacgtggctgaatgtgcccttgaactggtattggctagtttggatgaaaaaaagaggccagagccaggaataactcgaatgcgtcgtcatttatgccgtcgtggaagtctgagtagaaaagcttgattgagtaccctcattgaacatgagggtgccttattaatacgatcaaactctttgaaatacgtttgctaacgtaactttaagactattctgactaaaattcttttgaacagagttttatgacctgaaaatccgataacttgttactaaaaatggcaaggtgaatgatctacacgtaaagtcagacgatttacatcgtttacttctgtgacggagagatttttttattgatttgatatttaatgactttttattcccaatagtcattaaagttcaatttgttattattttttgttgtgttataacttaaatgtatttttattactaataggtttcatttgggtaacaattaggctgcaatgaaactttagttacataaattaatttaagtggtaattatttaacctaaattttttttctaagaatatactctccatcgtggttaatttatttaaaattatcatagtgttatctattattaatattgccaaatctgaaaaatctctcttcttctctctgaaatctttctgtaaatctagctaaagcacatgggctctggcttgacaaggttttcataccatccgtaaactcttaattgtggtgatttgtgggataatgtggagatttttaccatcaaggggtaacctgagtatgtttcgtggagcaacactggttaatctcgatagtaaagggcgactcactgtacctgcccgatatagggaaatgctgaatgaggaatctaaaggtcaaatggtttgtaccattgatctccatcagctgtgcctgttgctttacacattacccgaatgggaaatcatcgaagaaaagttatctcgcctatccagcatgaatctagccgaacgtcgcgttcaacgtttgttattggggcacgccagtgaatgccaaatagacagtgcagggcgccttttgttagccaatacactgcggcagcacgcagggttaacaaaagaggtcatgctggttgggcaatttaataaatttgaattgtgggatgagcaagcctggtatcagcaagtacagaatgatattgaggctgaacaatccacacaagaacctttatcagcaaggctacaggatttatcactataaatatggcaaatagtcattataagcataccagtgtattactggacgaagctgtcaatggactgaatatccgagaaaatggaatttatattgacggaacattcgggcgaggagggcattctcgcctgattttgtctcaattaggggcagatgggcgtttaattgcgattgatcgcgatccgcaggcaattgaagcgtcgaaagccattactgacccgcgtttttccattactcatgggccattttccgaattggctacctatatagaagaagcgggactggttggaaaaattgatggtgtgttgctggatttaggggtttcctccccacaactggatgatcctgaacgtggtttttcatttatgcgtgacgggccgctggatatgcgaatggatcctacccgagggcaatcggccgcagagtggctgatgaaggccgaagccgatgatattgcatgggtactgaaaacctttggtgaagaacgttttgccaaacgtatcgcgagagccatcgtagctcgcaatcaggaaggatcaatcacgcgaaccagagaactggcggaattgattgctcaggcaagcccagttaaggaaaagcacaagcatccggcgacgcgcagttttcaggctatcaggatctacattaacagtgaactggaagaaatagaacgcgcattgaatggtgcattgcaggttctggcaccgcaggggcgattatcagtcatcagtttccactcgttggaagatcgcatcgtgaagcgttttatccggcagcatagccgggggccacaggttccagccggtttacctctcactgaagtgcagttaaaagctcaggggggacgcagtctgaaatcaattggtaaactgaagccttcagaggacgaagtggcaataaacccaagagcgagaagctctgtgttgcgatttgctgaaaaggcaggtgagtaaatggcaggtgagcgtcatggattagtgggggtcattggcagggatttaatccgcaatgccaagatcccactggttttgctggtagcggtaatcatttcagccgtcagcgttgtgacggttgcccataaaacccgcttattgatagcggaaaaagagcgctcggcgattgattttgattctctggatattgagtggcgtaacctgctccttgaagagaatgccctaggtgatcacagtcgtgttgaaaatatagcgactgaaacattgcatatgcaacatgttgatccagcgcaagaaaatattgtgataactcaataagttcagttgacaactaaaaggtaggcgatgaaagctgcacgctctttaaagttgaaaaagcaagaagataaagccagttttgtaagctggcgctttgctttgctgtgtgggggcatttcgtttgctttgttcgggcttttgattcgtgttgcttacttgcagattatcaatcctgaccgtttgctaaaagaaggtgactcccgttccttacgcgtccagtccatcccgaccactcgtggtatgataaccgatcggaatgggcgccctttggctgtcagcgtaccggttgatgcagtttgggctgaccctaaagaagtctttgaaaaaggtggcataacggatgatacgcgctggcaagcgttggctgacacgctctccataccacttaatcaactgacccgtaaaattcaggattatccacaggggcgttttgtctatcttgcccgtcaggtcaatacctccattggtgattatgtcgaaaaattaagattgcctggcatctatttgcgccaagagtcccgccgttattatccggcagggcaggtgaccgcacacattattggcgtgaccaatattgacgacaaaggcattgagggagtggaaaagagcttcgacaactggctgacgggtaagccggggagccgaattgtccgcaaggatcgcaatggacgggtcattgaagatgtttcgttcactgacagtcaggctgctcacaatctggctctcagcattgatgagcgtctccagactttggtctaccgtgaactgaccaaggcagtgatacttaataaggctgaatctggtacggccatattgattgacgtaaaaaccggcgaagttctggcgatggcaaacaacccatcctataacccgaataatctggcaggaacgccgcaagatacgatgcgtaaccgtgccatcacggatatttttgaacccggttctaccgtaaaaccgctagtggtgatgagtgcgttgaatcttggcattgttaaagaaaattcggtgctggataccaaaccttatcgattgtcgtatggcgcacgttcgcatcaaatcaaagacgttgccccgcgtgctgaattaaccatcactgggattttacagaagtcgagtaacgtgggtgtttctaaactggcgttagcgatgcctgcctcggagctggtaaatgtttattcccgctttgggatgggaaaaccgaccaatttggggctggtcggagaaagtagtggcatatatccaaaaagagaacggtggtcagatcttgagagggccaccttttctttcggctacgggctgatggtaacaccgttacagttagcgcgagtctatgcaacgataggcagctttggtatctatcgcccgctgtcaattaccaaagtagaccctcctataccgggaacccgcgtgtttcctgaacccattatgcgtaccgttgttcacatgatggagagcgtggcactacccggcggcggcggggtgcgcgccgcgataaaaggttatcgtatcgcaatcaaaacgggaacagcgaaaaaggtggggccggatggaaaatacgttaataaatatatttcctataccgcagggattgcccctgcaagtaatccacggtttgcattggttgtgatcatcaatgatccacaagccggtaaatattatggcggtgcggtttcagcgcccatctttggcaccatcatgagtggtgttttacgtacgatgaacgttgaacccgatgcactgcctgcggatgataaaaaagaatttgtgattgataataaagaggataaaagtggcagatcgtaatttacgcgatttactggctccatggggtgttgatacaccggagcttccgctgcgcgaaatgacattagacagccgtaaggcggctgccggagatttgtttgttgcagttaaagggcaccagacagatggccgaaaatatattcctcaagccatcgctcaaggtgttgccgcggtgattgcagaagcgaagggaaaaacggataacggcaccattcaagcaatgcacggtgttccagttatttatctggatgatctcaataataaactgtcaaaattggcaggcgaattttaccagcatccgggtaataaactgaaactcgtcggagtcactggaaccaatggcaaaaccacgacgacacaattgctggcacaatggagtcagggtcttggggaaatcagtgccgtaatgggaacggtaggaaatggcctgctgggaatgatagttccaagtgaaaataccacgggttccgccgttgatatccagctcgatttacagcagctcgttaatcaaaaagccacttttgccgcgatggaagtttcttcacacggtctagtgcagggacgagtggcagccctgccatttcaagccgccgtttttaccaatttaagccgtgatcatcttgattatcatggtgatatggaaaattacgaagaggccaaatggttgttgttcagcagccatgatgtaaaacagaaaatcattaatgccgatgatgacgtggggcaaaaatggcttgcccgtttaccagaagcggtggccgtcacgatggaaaatcgcctgccggaaaattggtcagggcgctggttatccgccagtgacacccactatcacgacaaaggtgcatccattacgtttacctcctcttgggggcagggaactctccatagtcccctgatgggcgcgttcaatgtcagtaatctgctgctggcactcgctaccttactgtcactggaatatccactgcaaaaactattggaaaccgcttcctgtctggagcctgtctgtgggcgcatggaagtttttgctgcgcgaggtcgtccgacggtcgtggtggattatgcccatacacctgatgctctggaaaaagccctgtctgcggcacgattgcactgcaaaggccaactttggtgtgtattcggctgtggtggtgatcgcgataaaggtaagcgttcattgatgggcggtatcgccgagcagggagctgatcgggtggtagtgactgatgacaatccccgcagtgaagaaccccattctattgttgaagatattttgaccggtttcatcgatccgggtcgggcgatggcgattcacgggcgtgttgaggcggtgaccagtgccattatgcaggctgctgaagaggatgtcgtactggtggcgggtaaaggtcatgaagattatcaattagtaggcaaccgccgtttggattattcagatcgtctgactgttgcgcgtctgctgggggtaattgcatgatcccgctgacactcaagcaattgacacagctgacaggcggcgtgctatatcacatttccgaacagcaggcggctacttgccaaatcaataccgtggaaactgatagccgaaaaatggtgcgtggagggctattcattgccttaaaaggggaaaagttcgacgctcatgatttcgtggcggatgtcgcgaaactgggagccggtgctttgttggtcaaccgccgccttgaaattgactgccctcaggtggtagtggaagacacccgtttggcgatgggcaaactggcggcttgggttcgccagcaaagtaaagcacggatagtggcactgactggttcatcgggcaaaacgtcggtcaaagagatgacggcggcgattctgcgtcaacgcggtcataccctttataccgcaggcaactttaataacgacattggcgtgccattgacactgttcaggctgactgaagaacatcaatttgccgtgattgagctaggtgccaatcacattggcgaaatcgcctataccgctgaaatgacccgtcctgaaagtgcgctggtgaataacctgtttgccgctcatctggaaggcttcggctctttggcgggggttgccaaggcaaaaggcgaaatttttgcggggctttcatcagcaggaaccgccatcatcaatctcgatagcaatgattgggcacattggcagcaggggatcagcgaaccgcagactgtatggcggtttgctgtttcacctgtgccagaagctgacttttacgccactgacattcaggagcaaccgctggcaacgagcttctgtctgcatacaccgattggaaatatcgaagtaacactgccactgccggggaaacacaatattgccaatgcattggccgccagtgcgctggtgatctctgtgggtgcttctctcagtgatattcgtgccggattattagaactgaaggctgtttcaggacgcttattcccgattcaacttgcagagggaaaaatcgtgctggacgacacgtataacgccaatatcggttccatgattgcggccgctgataccttgtcacagatgcccggttatcacgtgatggtcgtcggcgacatgggggaattgggagatcagactgttgagtgtcaccgtcaggttggtgaagccgtggcatcgacaaaaatagacaaaataatgagcgtcggtgagttcagttctcatatcagtgagacaagcggccgggggcagcatttcgcaaacaaggcggaattagttgcagcgctgtttcctttactggaacaacacgaaatgatttccatattaattaaaggttcacgcagtgccgcaatggaagaggtagtgaacatactgaaggggaacttccaatgttagtttggttagctgattacttggttaaatatcacacagtctttcacgtcttctcctatctgacgttcagggccatcgtcggcttactgactgcattatttatcgcattgtgggtggggccaactttaatcggctatctgcaaaaattgcagattggtcaagttgtgcgtgacaacggcccagaatcccatttcagtaagcgcggtacaccgacaatgggtgggttgctgattctattctctatcaccatgtccatattactgtggacgcgtctggataacccttatgtctggtgtgtgctggccgttctgctgggttacggcgtggtgggatttgtcgatgattatcgcaaagttgtccgtaaagataccaaagggctgattgctcgctggaaatatttctggcagtcagtcatagcattgggtgtggcgtttgccatgtacagtatgggtaaagatactgccgcgacacaactgatcgtaccatttttcaaagaagttatgccacaactggggctgctttacatcctgctggcgtatttcgtgattgtgggaaccagtaatgccgttaatctgaccgatgggcttgatggtctggctatcatgccaactgtgtttgtcgcagcgggtttcgccatcgtggcatgggcgatgagtaacgtgaagtttgccctttatttgcacatccctcatttagtccatgcgagtgagctggtgattgtttgtaccgcgattgttggggctggattgggcttcctgtggttcaacacctatccggcgcaagttttcatgggtgatgtcggttcactggctttgggcggcgcgttgggaactattgcggttttgctgcgtcaggaattcctgctgatcatcatgggcggggtatttgtcgtagaaacactatccgtcattttgcaggtgggatcgttcaagcttcgggggcagcgtattttccgcatggctccgattcaccatcactatgaattgaaaggctggccggagccacgcgttattgtgcggttctggattatttccctggtgctggtactgattggtctggcaacgttgaaggtacgttaatcatggctgaatatttgggtaaaaaagtcgttattgttggattggggctgacgggtctctcctgcgttgactttttcatagcacatggtgtgactccgcgtgtgatggatacccgcctagtgccaccgggcagcgataagctgcctgatgacgttgagtgtcacacgggtagcctgaatacacaatggttgatggacgcagatttaatcgttgccagtccgggtattgcactggcaacacctgagttacaggcagcggccgacgccggcattgaaattgtcggtgatattgaattgttttgtcgtgaggcgacggcaccgattgtcgccattacgggttcaaatggtaaaagcaccgtcacgactcttgtcggggagatggcaaaagaagccggatggcaggttggtgtgggaggaaatattggtgttcctgcactggaactgctgaaacagccttgccagttgtatgtattggaactttccagctttcagcttgaaactacttatagtctgaaagctgccgcagcgactgttttgaatgtcactgaagaccatatggttcgttatccggacgggttgtcgcaatatcgtgcagcaaaactgcgtatctatgatcaggcaaaagtgtgcgtggtgaatgaacaggatgcattgacattgccggaagcaggtaaagatagccgctgtatcagttttggtgtggatagtggtgtttatcagcttgagagtggacgtcaacaactggtggttaaccatcaatctttattggaaacccgtcagattcggttgacagggcaacataactatatcaacggcttggcagcattggcgttggctgatgccgtaggtatccctcgcgaagccagtcttcaggcattgcagacttatccggggttggcacaccgttttcaagtcgtgcatatgagacatggcgttcgttgggtaaatgattccaaggcaacaaacgtcggcagtacccaggcagcactcagtggactgacattggaaggtacgctctatcttttactcggcggggatggaaaagccgctgactttactccactgcaaccttatgtatcgggaaataacattcgcctttattgttttggttgtgatggaaatcagctggcgcaattgcgtcctgaaatttccacgttgacagaaacgatggaacaggcaatgagagaaattgcaccgaagctgatgactggcgacatggtgctgctgtcacccgcttgtgcgagctttgaccagttcaatggttttgaacatcgcggccatgaatttgcccgtttggcagaggagttaggctaatgactattccaggcctcggtaaatttaaaaattggctgacggggaacgtggagaccgatgccacggatatcgtcatgtatgatcgtaccctggtctggatgatattgggattggctgtgataggttttgtgatggtgacatcggcctcaatgccagtgggtcagcgtctcgcacaagatccgtttatttttgcgcagcgtgatgcaatttacttggtgctggcgtttatattatcactcatcaccttgcgcatcccaatggagttttggcagcgttacagcaacattatattgctgggcacgatcatcatgcttgttgtggtgctgctggttggcagctctgtcaatggtgcatctcgctgggtggcgattggcccattgcgtattcagccagcggaattatcgaagttgtcacttttctgttacctatcgagctacctggtgagaaaagtagaggaagtgagaaacaacttttggggtttctgcaagcctatgggcgtaatgattgcgctggctattctgctattggcgcagcccgatttgggaaccgttattgttttgtttgtgacaacgctggcactgttgtttctggccggtgccaaattgtggcagttcctagccatcattggctgtggaatatttgccgtctgcgtgttgattgtcgctgaaccttatcgtatgcgtcgagtaacctctttccttaatccgtgggatgatcccttcggcagcggttaccagttaacacaatcgctgatggcatttggtcgtggggactttttcgggcagggattaggaaattcaatccagaaaatggaatacctgcccgaagcgcatactgactttattttctccattctggccgaagaattaggttatttgggtgtggttttagtgttgtcaatggtattcttcgtcgcctttcgcgcaatgatgattggtcgccgagcattacagcttaatcagcgctttgctggttttttggcttgtgcaatcggcatctggttcagctttcaggcattcatcaatgtcggtgcagcgtcaggtatgttgccaacgaaaggtttgacattacctcttgtgagttacggtggttcgagtttgatcgtgatgtcaacggctatcgtcttattattgcgaattgattatgaagtgcgtctggcaaaagcacaggcgtttgtaaggagccccaaatgagcggcagaaaccggcgtttaatggtaatggcaggcggtacgggaggccatgtttttccgggactggcggttgcccaacatttaaaagaacaaggctgggaaattcgctggttgggaaccgctgatcgtatggaagcagatttggttcctaaacagggtattgatattgaatttatccaaatttcaggattgcgtggcaaaggaataaaagcactctttgcggctcctgtcagaatttttaaggcgatccggcaggcaaaaacgatcatgcgccgctatcagccggacgttgttctgggtatgggcggctatgtctcagggcctggcggaattgctgcatggctgtgtggcattccggttgttctgcatgaacagaatggtattgccggattgaccaaccgctggctggccaaaattgcgaaaacggtcttgcaggcatttcccggcgcattttctgatgcacctgttgtcggcaatcctgtgcgtgaagatgtactggcgctgccagtgcctgcacagcgtctggcaggaagagaaggatctatccgtgtactagtcgttggaggtagtcagggtgcaagaattctgaatcaaatcatgccagaagtggctgaccgtatgggtgatcacatcactgtatggcatcaggcaggaaaaggcgcgcaggaagaaacacacaaaaaatatgaaaattcagctaaatctgaattcaaagtgactgaatttattgatgatatggcgcaggtttatgcgtgggctgatatcgtggtgtgtcgttcgggtgcattgacggtcagcgaagtttctgcggcaggattacctgcgatctttgtgccatttcaacataaagatcgccagcaatattggaatgctttgccgctggaaaacgcgggggcggcaaaaatacttgaacagcctcaatttacggccgaggccgtagtggatctgctcacgcagtggcagcgtccacaattgctggaaatggcagaaaaggcgcgctccgttgccatcgtcaatgcaacggagcgtgtggcagcagcgttgatcgatgctgttaaaaatcattcaggccgttctaagtagaacggagacgtaaacataactagtgaagattaaaacgtgaatacacaacagttggcgaaattaagagtttccgtgcctgaaatgagaaaagtcaggcatatccactttgtcggcattggtggtgctggcatgggtggtatcgccgaggtgttggctaatgaaggttatcagataagtggttctgatttggcacccaatcccgtcacacaacagctgatcgcactgggtgcaaccatttatttcaatcaccgttcggaaaacgtacgagatgccagtgtggtcgttgcatccacggcaatctctgcggacaacccagaaattattgctgcccgtgaagcacgtattccggttattcgccgggcggaaatgctggcagagctgatgcgttatcggcatggcatcgccatcgcgggaacgcatggaaaaacgacgacgacagcgatgattgctggcatttatgctcaggctggccttgaccctacattcgtcaatggggggctggttaaggccgcaggcacacatgcccgtcttggaaccagccgttacctgattgctgaagcggatgaaagcgatgcttctttcctgcacttgcagcctatgatggcggttgtcaccaatattgaagctgaccacatggatacctatcagggggatttcgaaaatctgaaacagacattcgttaatttcttgcataacttgccgttttatggtcgtgccgtgatgtgcattgatgatcctgtcgtgaaagagttaattccccgtattgggcgttatatcacgacctatggtttcagcgaagaagcagacatccgcattacgcattacgagcagaagggagcgcagggttttttcaccatcagccgtgatgacttgccagaactgcatgttgtattgaatgcaccggggcgtcataacgcgctgaatgcgacggccgctgtcgctgtagcgacagaagaagggatcaatgatgctgctattctggcttcactggctgaatttcagggaacggggcgccgctttgattttctgggtgaattctccctcaaacatattaatggcaaagaaggtagcgtgatgctggtggatgattatggccatcatccaaccgaagtcgatgccacgattaaggctgcgagggcgggttggccagataagtgtattgtgatgctgttccagccgcaccgctatacgagaactcgtgatttatatgatgattttgccaatattctgagtcaggtggatgttctgttgatgctggatgtgtattcggcaggtgaaaccccaattccgggtgctgatagccgctctttgtgccgtaccattcgtagtcgtgggaaattggacccgatttttgtgtcagatccagagcaaatttcagccatgctgtcacaggtaatggaaaacaatgatttagtgttgattcagggtgccggtaatatcggtaaaatagcgcgcaatctggctgaaacaaaattacagccgtcttttaatgagggagagcatcatggttgagaaggtcgctgttctattgggcggaacatccgctgagcgggaagtttcactgcaatcaggacaatctgttgtggctgggctgaaagaagcaggcattaatgcgtattcagtcgatacaaaagactttgatgtgactaaactcaaaggagaagggttcagcaaagccttcatcgctctgcatgggcgtggtggtgaagatggtacgctgcaaggggtactggagtttttgcagatcccttataccggcagtggtgttatggcatcagctttgtcaatggacaaattgcgtacaaaacagttatggcagggagcaaagttgccggtttctccgtatgccgtaattaatgctcaaaaatttgaacaagttaatgattttcaactccaagaatatgttcgagaattagagcttccattaatggtgaagccgaatctggaaggctccagtgttggcatgactaaagtgaatgattattccgaactgcgcggggcattggaactggcgttccagtacgacacggatgtgctggttgaaaaatggttgtttggtcctgaatataccgtggcattcttgggcgatgagattttaccctctatccgtatccaagcgccggaagtgttttatgattacgatgcgaaatatctttccaatgaaacgaaatatttctgcccaagtggcttgagcgcggaaaaagaacaggaactggcagagattgcatcaagagcgtataaggcgctggggtgcagtggctggggtcgggttgatatcatggatgatggcaatggtaatttctatctgctggaagtgaatacatctccaggtatgaccagccatagtctagtaccgatggccgcacgtcagtccggactcagtttttcacaactcgtggtgaaaattctggagttggccgattgatatgtcacaggcagcccggaatacccgggagcgagaaagtgaaacacaaagctcccgccccagtaatggctatcatctagcagggattgttttcttcctgatggtgattggcaccatcgtatggggaggctggatgacattggactggatgaaggattcaaacagattagcgctctcaaaactggtgttgactggtgaacgccattacaccacgaatgatgatgtcaggcgagcaataatggcatttggcgcgatcgggacatttatgacacaggatgtcaatattattcaggggcagatagaacggctaccgtggattcggcaagtcactgtgcgtaaacaatggcctgatgaactaaaaattcatctggtagaatacgtgccttatgtgcgttggaatgatacgcacatgctggatgtagaaggaaatgtatttagtttgccgatagagcgtagtgtcaaaaggcattacgccatgctttctggccctgaaggtaaagagaaagaggtattggcagaatataacaaagtagcgcccttgtttactgaacataaaatgaaattgaaaacggtgatcatgacggagcgtaatgcttggcaattaattctggataacgacattcggctggaactgggaaataaaaatgatgtgaagcggattaaacgttttattgaactttatcctgtgttgcagaaaaacacggagaaacgcgtggcttatgtagacttacgttatgacagcggcgctgcggtaggttgggctcctttattaattgatgcgccggtttcaatcaacgggcagaaaaataacagtgactggcaataatacagagacaggcagaataacaatgatcaaatcaacggacagaaaattggtagttggccttgaaatcgggacagcaaaggtatctgccctggttggtgaaattctgcccgatggtatggttaatattatcggagtgggaagttgtccatcccgcggtatggataaaggtggtgtcaacgaccttgaatcggtcgttaaatgcgtacagcgtgcgattgatcaggctgaattaatggcggactgccagatatcttcagtttatctgggactttccggtaagcatatcagttgccagaacgaaattggcatggtgccgatttcggaagaagaagtgacacaggacgatgtggacagtgttgtccacacggccaaatcggttcgtgttcgtgatgaacaccgtattttgcatgtgatcccacaggaatacgctatcgattatcaggaagggatcaaaaatccggtcgggctttctggcgtgcgtatgcaggcaaaagtccacttgattacctgccataacgacatggcaaaaaatattgtaaaagctgttgaacgttgtggactgaaagttgatcaacttatttttgcgggtctggcggcaagttatgctgttctgaccgaggatgaacgtgaattgggcgtttgtgtcgttgatatcggcggcggcacaatggatatcgctgtatacactggcggcgcattgcgccataccaaggtgatcccttatgcaggaaatgtcgtcaccagtgatatcgcctatgcgtttggaacgcctccaagtgatgctgaaaccatcaaggttcggcacggttgcgcattgggttcgatagtcagcaaggatgaaagtgtagaggttccaagcgtgggaggacgtcctccccgtagcctgcaacgccagacgctggctgaggtgatcgaacctcgttataccgaactgctgaatttagtgaatgatgaaattctgcgattgcaggaacaattacgtcagcagggagtaaaacaccatctggcagcagggattgtcttgaccgggggaggagctcaaatagatggcgtggctgaatgtgctcagcgggtattccatacccaagtacgtattggccgtcccctgaacattactggtctgacggattatgtgcaggagccttgctactcaacggcagtcgggcttctgcattacggcaaagaatctcaccttggtggcgattctgatgccgataaaagaacgtcagtgagcggctggttcaaaaaagtcagcagctggctgagaaaagaattttgattttttatacagaggccgcgacaatgacgccggcctcgacataaaggcacaaaacggagagaaattatgtttgaaccactggaattaaccaacgacgcggtgattaaagtcatcggcgtcggcggcggcggcggtaatgctgttgagcacatggtgcgtgaacgtattgaaggtgtagacttctttgcgattaacaccgatgctcaggcgctgcgcaaaacagctgtcggtcagactatccagattggcaacggcattacaaaaggattgggcgctggtgcaaaccctgaagtcggccgtactgcggcagaagaagatcgcgaagcattgcgtactgccctggaaggtgccgacatggtattcatcgctgccggcatgggcggtggtacgggaactggcgcagcccccgttgtggctgaaattgccaaagagcttggtattctgaccgttgctgtcgttaccaagccattcaatttcgaaggcaagaagcgaatggccttcgcggaacagggtatcactgaactgtccaaacatgtggactcactgatcactattccaaatgacaaattattgaaagtgctgggtcgcggcatttccctgctggatgcattcggtgcagccaatgacgtcctaaaaggggcggttcaaggtatcgctgaactgattactcgcccaggactgatgaacgttgacttcgctgacgttcgtaccgtgatgtctgaaatgggatacgctatgatgggatcaggtatttcacaaggtgaagaccgtgcagaagaagcggctgaaatggctatttccagcccgttactggaagatattgatctttctggtgcacgtggcgtgctggttaacattactgccggctttgatttgcgtctggatgagtttgaaacggtgggtaacacaattcgtgcatttgcctctgacaatgcgacggtggttatcggtacgtcactggatccagacatgaacgatgagctgcgtgtaacggttgtggcaacgggtattgggatggacaagcgtcctgaaattacgctagtgaccaacaacaaagtatctcagtcaaatacactggatcgccgttacccgcagatgtctggtggaatcccgtcattgtctgaagagaaaaaaaccgctgcaaaagtggtcaatgatcaaaatgcgcagacaagcaaagagcctgattatctagatattccagcgtttttgcgcaaacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16907 - DNA, 1221 bp, Xenorhabdus bovienii
  unsure (1)..(1221): unsure at all n locations
agacttttgtgccgcttgtattagccagcagagttccatattcagcgcctatcgtccatttcattcgtcgccagaatgaccatgccgactttgagcggacatanngccactttcnnccagttggctgtagacgagggcagaaagctgataatgaccactatcgggatgtgacctttagccggggcgncctcgccccttatgcacctcgattttttgaactttggggcctcaatgccgataaactggcattctgcttcgaagtcacacaatgcctgcaaagcatcttcatcacagggaaacgacttcttgctgagtttttcgaactgtttcagttctttttccgtcgaaatccgcgtatttttcctgaaagtctgatgttcacactgcatcgccgcttcactgttgaccagtaaccagcgctgtggaacgcccccgtagcaagattcaatccaatgaccggcataaccttctgtaaccggttgtaactggtcggtattaaccgtcagcaggtgctgtttcgcctctttaatggttaacggaacccgggtaataaatttttgattttgttgatgaagtgaggccagtgtctcttgggtataaagcgcggcatcggcaatcagataacggctgttttgggccgctttcaggcagccaatgtgatgtttcgtcgtctctgcaaacgctttggtgtcgttggtgtttccgctcatcgcctgcatgtatacggggatccccgcctgattttcacagataagttgcagcacaacctgattcaggtcaggacggtgatcacgactgtaaccacgcaccaaaacgaggcgttttgtctcgtcatcatcggggagtttgtactcaccatccacgtgaaaactcgtgatatcaaggtgaacggaatcggattttaatgccaatttatcaataacccgctcagcgataacctgataaatttcagagacaccgcagtcaaacaaagcgtccagcgtgcggccgagcacatcatcattgaggtgttcagccataattcccaccccaatcaggcgttcaacgggtttgtgcttaaaaaaatcagggcacatatggagcgttcgactgtggaaacccaacccattgaggatcatcgctaaaagagcctcgccatgagaaaccgtatgctctgcatatttaggcaaaatagcatcaatcatggggggtaaaccgatctcatggcaaaagcnnnnnncg

SEQ ID NO: 16908 - DNA, 164808 bp, Xenorhabdus bovienii
  unsure (1)..(164808): unsure at all n locations
nnnnnnnnnnnnnnnnnnnnnnnnnnnatgacgcattcaaacgcgctggcaatgaaaaatcgagctgcacagtaccacattgccacgcacgatccaaacaatcatatagagtaaattcgatcttagggccataaaaagcaccttcacccggctgatattcaaattcaataccgctttgtttcagtgcttcagcaagatcagcttccgcttcatcccactgtttgtcagtgccaatacgtttttctggacgagtcgataatttgacaacaatcttctcgaaaccaaacgtattatacacgtcataaatcattttgatgcagctgctgacttcttgatgaatttggtcttcagtacagaagatatgtgcatcatcctgagtaaagccgcgtacacgcatcaatccatgcaatgcccctgacggttcattacgatgacagctaccaaattcagccatacgcaacggcaggtcacgataagatttcagaccctgattgaaaatctggacatgtcctgggcagttcatcggcttcacgcagtattcacggttttccgatgatgtggtgaacatatgttctttgtagttttcccagtgacctgttttttcccacaggatacgatccatcatgaatgggcctttcacttcctgataatggtactctttcagcttgacgcgggcaaatgtttccagttcacggaaaattgtccaaccatcattatgccagaatgccatgcccggcgcctcttcctgcatgtggtacagatcgagctgtttgccgattttacggtgatcacgttttgaagcttcttctaagcgttgcaagtaggcattgagttgttttttgtctgcccatgcagtaccgtaaatacgctgcaacattttgttgtcgctattgccacgccagtatgcgcccgctattttctgcaatttgaagtgatggcaaaaacgcatattagggacgtgtggcccacggcacatatccatatattcttcatggtaatatagacccggatggtcatcacggctaatattctcatccagaatctggatcttgtattcttcgccacgagctgcgaatgcatcacgcgcttcctgccaactgacttttttcttgatgacgtcataatctgtcttggcaagctccagcatgcgtttttcaagcagctcgatatcttcctgcgtcaaagagcgatctaaatcaacatcgtagtagaaaccattgtcaatcacaggaccgattgccattttcgtatcaggccatagctgcttgactgcatgacctaataaatgtgcacatgagtggcgaataatttccagaccgttttcatccttgctggtaataattgcaaggttagcatcggtttcaattaattcacatgcatccaccaattcgccattaacacggccagcaatacacgcttttgccaagcccgcaccgatatcgcgagccacatccattacagaaacggcatgctcaaattgacgttgactaccgtcaggaagagtaattacaggcatttaaaatccttatctacagtggtgacccacacgaaagatcacttgtatgaaatattttaatttaagaattcaatacgttaagaacaaactcttgcttcactccgcaagatgtgtactcgattaagtacattatttttaaagtacccagtacatttgccctaactcattcaccatactatcacactgagtaagtgttaaaatagcttaacgtgatattcagccatcttgaactacctaaaatatctaataattattacggtagaaaattaagtaaaatgctgttgaaatatacgccatctggattcaacctgatatctaatacacaacgttttctcttataagtctgatgatatctgcattgatattggatgattttttaaacttttcttaccatacattccacgttctatatcgtgatctttttcattaactaaatcttgggaatttccctgcgcaaatgattgagtgaaaacatacaataaaaagttaccgtgtaatctattgattaaccaatatcaattatcaatgatatccaaatcgcggtaggcattttttactttccataaataacgaggagcctgtggtgcgggatgattattctgaacatattgataaaactcatttggcgtcattcgattaattttattgattgccaaagttctgtttgaatcaaatgtacgcaatagtgctcctgcaccattaacataagcgactatcatcgcatagtacatcgtttcaggattagtgataccttccagatgctgctttttcaggatgctaatgtaggcggttccaagatcaatgttggtttctggatctttcaactcacgcatagttggctgccccgattttccttttattcgataagcatctcgccctgctgtagatgccttgatttgcattagaccaacagcattggatttactgacgacttctggacgaaaaccagattccacccgaataatcgctttaataagcgtttcatcaacaccataacgccttgcagcctgctcaataaaacgatcaaatggtgttgattcagatctagccataaatttacggggactagaaacaacgttattgttaccgagcaggcgttttgctgttagttgcttaccaactcctgactgatgaatttcttggtctgcacatcctgtcaatagcattgccagcacaatatagccgagtcttaatttcacgctgtcttccccaaaccaaaattaactttataaatcatatataactttactaataagcccaaaatacttttatacaacttatcaaaataaattgagccatttatattacgtaagcctagacaataggctaattttttgttcacatcaccttctttaccaatatctcagcaacaagaaagttaaggaatgtctatcaaactatcattaattttgtgtaatatcgccttgactttaaataaatgatattgataatcattatcaataattacatgtataacaagtaaggtttgccaaaatgaacaaaaggcgttcaatttctgctttcccgatattcagtatgattatcgcattattcacgctcactctattcagccagcaagcctatgcagataaaaaattcagggttgtaactacctttaccattattcaggatatggcccaaaatatcgcaggtgatgcagccatcgttgaatccatcacaaaaccaggtgcagagattcacgattaccagcctacgccaaaagacatcattaaagcacagcgtgcagatcttatcctctggaatggcttgaatcttgaacgctggtttgaacgtttctttgaaaacatgaaagacatccctacggctgtcattactgagggtataatcccgctgccgattcgtgaaggaccttacaataaaaatcccaatcctcatgcttggatgtctcccaaaaacgccctcatttatattgaaaatatccgcaagtctttcgttaaatatgatcctgcgaatgcagaagtttataatcgcaatgcgaaaatttacgcagaaaaaatggccaaactggatgcaccactcagggaacgcctttcccgtattccagaaaatcaacgctggctggtaaccagtgaaggggctttcagctatctcacacaagattatggtttcaaggaagtgtacttatggccaatcaatgctgaagaacaaggttctccgcaacaggttcgccgtgttattgataccataaggacacaaaaaatccctgtagtcttcagtgaaagtaccgtttcggataaaccagcaaaacaagtcagcaaagaaaccggggctcactacggtggaatcctatatgtcgattctctttctaccccaaaaggtccagtgcctacttatattgacctgctgaacaccactgtggacaccatcgcgaaaggatttaatcaatgagtcattcatcgttaaaccatcaatcattatttgagcatccccatttaattgttgatgatgctaccgtcacttacaacaatgggcacaccgccatatatgacgccagtttcgatattaccggcggcacaatttgtgcgctggtaggtatgaatggcagcggaaaatccacattattcaaaacaatcatgggattagttactccctcccacggaaaagtcaccctcaatgcacaaaccatcaagactgcgttaaaacaaaatatcattgcatatgttccacagactgaggatgtagactggaattttccagttttagtttccgatgttgtgatgatgggccgctatggaaaaatgggatttttgcgcagacccagtaaacgtgaccatcaaatcgtggataaagcgcttgaacgcgtcgggctgaatgaactgcgaaatcgacaaatcggtgagctttccggtgggcagaaaaaacggacatttttagcacgtgcactagcacaggaaggaaaagtgctactgttagatgagccttttactggtgtagacgttaaaacagaaaatgccattgtcgatttactccgtgacttacgtgatgaagggcatctagttttggtatcaacgcataacctcggcagtgtgcctgaattttgtgaccatgttatcttgatcaatcgcactgttctggctagtggcccaactgaaaccactttcacccaaaaaaatctggagacaacattcggtggtgtcttacgccatatcaacctttctggctcagagcttcatgatgatgatgatccgcgctcactgactgtcattaccgatgatgaacgggctgctgtcttctatggctatgaccgtcatgtcccaccacgacaaagccaaaagcagaaggaaaaccagccatgatggagttgctgatacaaccattcaattacaactatatggtgaaagccatgtgggtaagtgccatcgtaggtgcagtctgtgcttttttatctgcctatctgatgctgaaaggttggtcgctgatgggagacgccctttcccattctgttgtaccgggcgtagcaggcgcatatgctctcggtttgccttatgcaggtggagccttttttactggtatgctcgcggcattatcaatgactctggttcgtcatatcacgcggttacgtgaagatgcggtgatcggttttatattctccacttttttcgctgtcgggttattaattgtttccttaaaccccacttccgttaatgtgcaaaccattattctcggcaatatcttaggcatttctgatgaagatgttttgcaagtcgaaatcattattgctgtctcctttattatcttaatgctgatctggaaagatcttttagttgttttcttcgatgaaacccatgcacgttctatcggtttatcacctctgcggttaaaaatcattttcttcaccttactcagtgcctgtactgttgccgcattgcaaacagtcggcgccattctggtcatcgcaatggtagttactcctggtgccacagcctatttattgacagatcggtttaagcacctgcttatcattgctgtcaccatcggatcattaacgagtgctatcggtgcttacttgagttacttcctcaatggtgcaacagggggagtgattgtcacgctacaaactgtgattttcctactggctttcttctttgcccccaaacatggcatgttagcgtcccgcagacgagcgaaaaaagaatctttagcattaactcaaggaggacgctcatgagtacattgattgaattcattactgaacccttcatgcatgattttatgcagagagctattttcgcttctgtcatggtgggggcagtctgcgcggtactttcctgctatctagtattaaagggttggtcactgatgggggatgccatttcccatgcggtcttacctggtatcgtattagcatttgtcgctggaataccactcgcaataggtgcttttctttcagggatattttgcgcattcgctaccggatatctgaaagaacacagtcgaatcaaagaggatacagtcatgggtattgtattctccggcatgtttgcattgggtttagtcctgtttactcgcatagataccgatcagcatctgacgcatattctatttggtagcatacttggcattacccagcatgaattgatccagacactatgtattgctagcgtaacactggcaattgtgttgctgaaacgcaaagattttatgctctactgtttcgatcccaatcaggcacgcgttgtcggtctccccgtgaaacttatccattatggcttattgtccctgctggccttaactattgtcgcatcgctgcaagccgttggcattattctggttattgccatgctgatatctcccggcattattgcatttatgctctgccggagttttgatcgcatgcttattgttgcaatgattgcttctgtgtcatccagtgtgctcggtacaataatcagctttcacatcgatggtgaaacagggccttgtatcgtcattattcaagctattttcttcataacagcacttatttatgaccaaataaaattagctagaaagaaaatgagcaagaagcgtaccaaagatatcccatctccatcatcataaatttcaggtgaatcaaattaataaagtagagagccatatctaattttggatatggttctctattgagtgctatttaaatcactttttaacctgttcaattgttgcatctgtctgtaatatgagcatagcaattgtcaacttaatgaggtgaatcatgtggcaagcagtgaaccgtctattaagtgagcattttggtggcgctgacattcacaataaaacagaattagcgggaggggatattcaccgttcttggtgcgttgagtacggcgaacagcatatttttatcaaatccaacttgaaagaaatgttgcctgtttttaaaacagaagcagaacaactggaattgctggcccacagcaaaactatccatgtccctcaagtttacggcgttgggtacgatcgcgaccacagttttcttttgctggagtatttacctataaagccatttaatgcctatagtgcatactactttggtcaacaactcgcgaaactgcaccaatggagtgaacaacctaaatttggttttgattttgataacatgctcgcgaccaccatacagcctaatggatggcaaaagcgctggaatcaattttacgcagaaaaacggattggctggcaattacaactcgcggcagataggggaatggtgtttggcaacatcgagcttattgtccaaataatcagtgacaagctacaatctcaccaacctcagccttctctcctgcatggcgatttatggccaacaaattgtgcatcattaaatagcaactctgccgcagcatttgatcccgcctgctattggggagatcgtgaatgtgaccttgccatgctgcccctttatccagagctacccctacaaatttttgatggttaccaaagtatttggccattgccacaaggttttattgagcgacaacctctttatcaactttactacttactgaatcgctgtaacctttttggaggggaaaacttcatcatagtgcaaaatatgatcgataatatattatctgaatagagattaccgctatctacttaatcaataaaaataaccatcattattattaactctgatctaacaccattgccaaaaatcggagttaattatctttatattaagcaaattaacaatgacgataaaacaaaattcacgacacactaaatacattaaccatgcttaattaatttttacctaatagataagataaaaaagaaaaatttattatattaggaaataaatgcttattggatagaacggaggtaaaaacactaccaatgccgattaaactactgaatatcttaataagctgcgaagagaagataaatgcttccgcagctgttatttttattttttacattaccaacccaatagttttgagaaaaaataagcaatcgcaccaataattattggtgatatataaaggataaaaatttgactgaataacgaatgaggaggaaatttaatcttagcttccaactgctccttggttattccgctttccttagcattttcaaggatcatttgatcttcgatatgttccttgatgaatttaaattggcgatacattcttaagcctgatgcactcattgccaacccaacgaacataagaaaatagatcacaaggaaactaacatttgtacctgtaatcatcaccatacgatcaggtattggtgaatgcttccagaaaaaatccaaaaatgatgtattgaatttgatcatctctgtcatcattcttaaaaaatcattcaatactgcataaattccacttcctttcacaccatgttgccatgccagattgatcactgagacaaaagttgacaaaaaagcgggtacaaaaataacccagcccaagatccgtttcgcaatagcaatatatccagcttgttgatacgtcattaacattcctcattagcataaatcattttatttttactcaatgatagctgataagagactaactttaacctcatttgtaatgtataactctcatttttcctagaaaacgatgcctttctttgttatttgttcataacgagatttaagacatagagcttgctacaattataaatctttaatcgttagcaccatcaaggagagatataagatgtcatttcatttacctatagaagccgccatttgtgatataactagccctattatataaattcataataaaaacaattaattaaatacagtcttgccgccataaaaacaataatgtacacgtttatgtacaaacgaaaaaagcatacaaaacccccaattcagtgaccacttctgtagcattaaacatgtttacgcttgccacaactttgatgggttcgcatcaagcactatgatcgctacgactttgcactaccgacgaaattcgtcgccagccatttcagttgcatacggaaagatccctcatgtacaaaaacatcaactgcaaaaaacttttcagttgtgaaaatctcacatgagcaaaaggtgttgaggaaatctcaatacctacaaaagcaaaaggtatggtggaaatcaccatacccaaggtgtgatattacaccttgcggcaaccgtggtgatttccaccctagttgcttaactcattgatttttccgagggggtcactttgaccacccgagacatctcttccgtaaattcgtctttatttcaactgttgggaaatcccaatggttactttatgtgctggacaaaaggaataaatgcattgtatttcaatgtgttaattgtgcgcaaggggctgggcaagcagacgccaaatctgtcgtctgattaaatatcaatgagttatcacttaaatgggcattcccacttaaatgggctttcaaatcccaattggcgcgatcagccaaaaatttgtccgattgagacgaggactccttattggcgaaaatataaactacgaaattttcgtagttgagcctctgagattgatgattccttaagctcaaggaatccttgtagttaatttcacatctccgtttgaaacggaagcgtgccggcaccatgcaagggttaaagacgggaaatctcacctttagataaccttttgattttgcgtaattctgtcactgtgccagagattaatgaaatcaataggttaggttaaagaggggaattgtcccctttaaactctaagttttatcagtgggatatggattttattaatttccaaacagccattccgtgccatcctaatcagaagttctctccagtattgatgaacctattttattgatgttcactggcggagcagtaaccaccgccttcatgttatttagcaatgagtattgttgattaaatgagggagtaaatatgagtattcaaaataataatcctgatacaccatgcccttgtgactgtgatcttttcgtggtacccagtcgtaattatgtaaaagaatctattgaagaacatgcccaaagccgcaatcaccccaatgcaacattgcaagataaaggatttgtgaccctgagtaatgatgctgacagtaataacgaaactagtgcagcaacaccaaaagcggtgaaaacagcgcatgacttagcaaacttagcaaatcaaaatgctaataatgcaaatataaatgctaataatcgcttagctaaagatcagaacggcgcggacattcctgacaagaaagcattcattaaaaacctcggtttagtgagcaattcaactttacctgtcggagtccccgttccttggccagcagaaaccccaccagaaggctggttgatatgtaacggtgactcatttgataaagcaacatatccgaaactggctcttgcctatccctctggaaacctacctgatttgagaggggaatttattcgcggttgggataatgggcgaggagcggacgttggtcgatctctactttctaatcaagtggcagatattgctccacatagtcacaggattggccgcatgtggtccagctcaaacggtggagtcgagggtttgggtacagggaaccgcattttcaatagtgtccaccaagacattaactacggaattgatcctcgcggactaggcattgctataggaatgggatctggtggtgtcggttatatggataatgcggttgctgcttcaacgggaacagaaacacgtccccgcaacgtagcatttaactacatagtgaaagcagattaattgattccacaggtaaggaagaccgcgctatacctagaaaatattctaatcccagcgatggaatggtcggacgaataatccttaacccgcaactttccgcgggttaagactggcttcattcttctaccatccccagcctcacaccaagccccccaacacccgcccacaattcacccaatccacccaactacccgctaatctcccctattggctatttattgaatgaagtaaggggcatcaagcccctgtgttcacttcggctgctccggccatttgacatcgggtgcggtagtgcaatccacccgataaagtgccagtcggtagcgatgccattcagtcaacgcgattttttcttcttcggttgcaatatccagatagaccgcatcctgcaaaggttcaattttccctcggatcggctgtatcagactccatttttgggattctgcctgttgctgtcgctcctcgggtgttgggggcggtgctggcggaatatctccccacgcgggcaaaccatcagcgccggcgacgcgcattttacccattggcggcgttgccgtgtatttttcaaaaacagcctcctctacatcgattccagcatcgggccatgaaccggcattgacataatcccgtttcatggcatacggatagaatgcattttgcgaggggctataatagtaataattcataatcagtatcctatattcctacagcaatccagctgatatgtgttgcagttctgttggtagtttttgagccaacatgccaggccgataaataaaatccaaatctatcaataacgccacagccgcttatgttagcagcgtcaggatcggttccagagctagtaacgccgtagcactgttttgggaatggcgttggaaaatttattattttaggttcactcggatctgattgcgcatagccgtactgaatcattttaccgttggggaatttcatgtgtccgcccccagcggagaaaaacgacatgtcggggatttgattaggcccgttgccgatggttcggtaaactaattcggataaacccagattgttcacaaactccggcttgttcggaatgtctgctccgttctggtttttctccaggcggatgttggcgttgtcgttgacagtgttaagcgccgaattagtagcataatcacccctgtcttgtttcccgtttatagctgcctgcaatgcccggatggagtccagcgtgactttctggccgttcggcatctccacttcaaccttgccgttttcactcatccatcgggccatgttttgcaggaacaggatgatagcggcgttaatggcacacatatgccggacaccatcggaaacggtatcgggaacggtggttgaaataacatatttcgcattgttaagactgactgagggcgcaaaggccagtaccagttccgtgtctgaattcaccgactggataacattctgaatcaccgtattgccggattgaatggagataatctggccggctgcaatgccgttaatattacttttccattgggtgcccgttccccggacaatagccgagcctgacacgagattcgttgtgccgtctgagtagatcatgtttgttttctcttcgtcgtaaatggcggtgtctatgtaaactatccggctgtgtatttagttaaggtgtgctacatgtcagaccactgactactgaccttaaacagcataccaataccggaagtagggtatgtaatgcccgcgccgtgggttgtgagaacaactttaatggtcggtgttgtattggcggggatggttatagggggtgtaaacaacgtgccggaaatacactgcgggccgcgatcaaaagactccatgctaaaatactgtccagccacatgcgcattattaacatatatagaaactgaggcttcccccgaaccacccaaagatccgacgtaacgttgagtcattatcggtccataaataaaaacccgatcaaacggcatagattccgttagccttttatgaaagaaaatgctctcacggttgcctaatgatacattccccaatgtgacagacaccacgtcacctacaattttggtcgcatataccgcgccggaaaaacggccatcagcgccattgattgtccctgaaaacgtcccgctggttgcatgtatctccccacgaacagtaacatggttgaattctgccccaccccctttatcaattttccatcccgcccggccagtaatataatttctggattggatgtaattgccaattttggcattggtaatactgccatcttctataaattcttctctggtaaataactgtccatttttcgccatcataaacggctccattttgccgctggccggattaaaccagccgaagttattggcactaaatccgatggaggtagtgacctgtccgttcttcacctcagaccccatcaccatcccggctttatggaactggtctttgtactttaatccgacacccacgtcatagagagcatacccatctcccttaatatcaaagaccgccgtggccttcgtctgcaccgctgccgcattctcccccacttcggcctgtaccttcttcatgtcctcggcaaaggcttgcctgtccgtaacctgcgtggtctgaacgtgcagtatctcggccttaagctcaccattcactttcaactgtcgctgaacaattgctccttccaccgcggcgatctccatgatggcttcggagttaaagtccatctgagactgcaaacgctggccggctttgttggaaagaaattcctcaccggccgcatcaatgatccagttcgtatccgaagaagactccccacgaatgaacgccgggggctttcaccgccgcccttgttgccccgaattaattgattagacatatttcacccataaaaaaaggccgccgtagcgacctgttaagactgttgacgtttattgctgatcttcggcatagatacccgccgagataatggcacccccgatacgacgcttgccgtatccaatcggaaccggattcccctgcgcgatggagttgactggccccccaaacgcatagctgggtttattgtcgggatcttcccgtcgtgccagcccacccggcatcggtgacagcatctgcaccacgccccccagcatcatagaagcaccggacatcaccaatggaacgccatacggggttgcccacaaaaacgccccggccactaccatcaccgcgccgagaatagtctggaagatgcctgcttttttgctaccaatgatcaccggtacaatccgaatgtcgccttcaccggataattccagttcgtcacggttgatattgcgttttccgatgaatacggcaaaagtcagcccgcgctctttcgcggttaacaggaacttttcaaagccgtcaataaggacagacagcgccctgatagcctctatgggggatgagactgccagcttatactgccgcccgaattggggtatcagcacgccggacaaccgtattgtgcgtaacgtattcatgaatttactccataaaaaaaacccccgttagggctgaggaatccccagaaaatagacaggcatagcgttgtgtgatctactgattgttccaccaagtcaataaggtcactgctatgcctgtacgtgaaatatgtcataacttctttaaagatgctttatcaccatttcataaatatcgtcagaatgcattaatcgatgccactatcgctttgattaatggtgcttctcttacgttaaccagcattgggcgctttttaccaggaaacgctcacgtcaaacataaaattaaacgtattgatcggctactcggtaatgaagctcttcatagggatattcctgatatctttcgtaatattattgctatgctgactgagtcactctcattgtgtgtcatagctgttgattggagtggatatccctcacaagaacatcatgtactccgtgcgagttgaatttgtgatggacgctcaattcctttgttaagtcaaatagttccctcatgtgaacaacaaaatgtaaccatccaaaatgcatttcttgacatgctagcgagtgctgttaaccctaaagctagagtaattattgttacggatgcaggttttcaaaatgcagggttcaaacagataaaaacgctcggttgggatttcgtcggacgcattcgaggaaatactcaactaagacttgaaaaatagggtgagctttggtttaaacggcaagctttaaaagcaactacaaccccacagtttttagggtttggcacattatcaaaagcagaatatgcacgttgcgatggttatttttatcttcataaaagaccgaataaagggagaaaattcaaaaaatcacgatatcgaatggtacgaaaatctcaggtcaaagatggacgttcggcagcaatggaaccttggcttatttttactagtatggatgattttaaacctcgtcaggttatgaaaatttacagccgaagaatgcaaatagagcaaaattttagggatgaaaagagtgaacgttttggatttggtcttagagcaagttatagccacggtactggtcgtttatcagtattgagtctacttgctacactgagttcagttgtactttggctgattggtttttatgccgaaaataaaggaatacatcttaattatcaggcaaatagtattaaatcaaggcgagttatctctcatcttacattagcggagaatgtattacggcattccccgctaatattatttgaaatcgttcttaataacacactcaaatatctcgccaaaatctaccaaaacatggttttgatttattagcgctaatttgtggggatccctcagagctataagctggcttacataactaattattgatttagtcaataatagcatcaggacgaacacctgtttttagagcgtctggacgaacacctgttttcaaggcatcggggcgaacacctgattttaaggcatcaggacgaacaccggattttatagaactattcatatagcctccataatatagagttgttgtgttttattaattaaatgattttaatattacgagataacactcgcaaaacgtaatttggcatcatatttacaataaatcaacttacgcttaatttatttcacctataaatttatatgacattcaataaacaatcactgaattaaataaaataaattgttattttaatttttaatatattgatatatataatgaataatattatttcaatcattaagtattcaaatgaatcaaaaaataatttttgttgataaaaattatcaaatgctattttaagctgttaaatatactttttagttgtaaatccatatttaaattgatttaataaactcaatcagaatattgtgtttgtttttaattaaattattttgttttattttgttttattttgttttattttgttttattttgttttataaaattaataagtattttaattttttatggaaatttaatttcttaatatgttatttaacttactaaattataacagtgattttcatggaaagttaatatttaggatagttaaagtattaaagctggtatggtagtttattatccgatggaatcgggtattcaagttttttaagccaatgaatggaaatgaaattgtctctttcatatatcaccattgtcagtgggggcagtttttagagcgcttattaagaaccactttcaatgatatgaataaattatatattgatatgaaaatcattactccggtaacatctttcctaatttagcaattaatctgtgattgatccttgaggagatagaataatggttgttacaaacgatgagattcaacaccatgatattcagacccgttatgccaatatttcagttctcgataccggtggaaacgggctgccagtgctcctgatacatggtaattcaagctgcaaagaaatctttcgtcatcaaattgagtatttaaaaggggactatcgggttctggcattggatttacccggccacggtaaatcttctaacgccagcgatccacgtgaagcatactcaatgtccggttatgcccgcaccatcattgaagtgctggaaaagatgggcattgataaagtcgtggtctttggctggtcactaggggggcatattgggttagaaatgctggcattgaaccctaaaatgatcgggttgatgatttgtggcacgccgccagtggccgcagggagagagaatgtagcccgtggttttcgtcaaagtgaactgaggcttaccggtaaagcggaatttactgacgaggatgtcaaaaactttgcccgtgagacaaacggagtgaatgcacctcatgaaccgtttatgatagaagccgtggcaagaacagacgggttagctcggcagtatatgtttgaagcttctgtttcccctcaggcgacagatcagaaattattggctgaaaccagtgaagttcctttggctattgtcaatggtgctggggatcctttcatcaatcacgattatattaatggattaaattataaaaacctttggaaaggccaagtgtttaatctggccggcgtcgatcatgcgccattctgggaggctccaaatatttttaacccgattttagctgagtttctaaaaggtttttaatagtcttaagagagcctgagcgggaatttctttgttttatttaaagaagttcccgctattacaggcatgttttttgtgtattttttatttaagtgataatgctatttaaaataatgtatccgtcattccgcacctcattcctgatttaaaaatcatgtgatttgccgcacgctttgttgatttactcctcaaatcagattgacggcaatcttcggttttgatctattacttctatttaccggaagcccaacatgtctctctctgaacctgccatcaaacgtctcgatcacctcggccttgtcgccgctttttgccatgagatcggtttaccccgcatgattgatgctattttgcctaaatatgcagagcatacggtttctcatggcgaggctcttttagcgatgatcctcaatgggttgggtttccacagtcgaacgctccatatgtgccctgatttttttaagcacaaacccgttgaacgcctgattggggtgggaattatggctgaacacctcaatgatgatgtgctcggccgcacgctggacgccttgtttgactgcggtgtctctgaaatttatcaggttatcgctgagcgggttattgataaattggcattaaaatccgattccgttcaccttgatatcacgagttttcacgtggatggtgagtacaaactccccgatgatgacgagacaaaacgcctcgttttggtgcgtggttacagtcgtgatcaccgtcctgacctgaatcaggttgtgctgcaacttatctgtgaaaatcaggcggggatccccgtatacatgcaggcgatgagcggaaacaccaacgacaccaaagcgtttgcagagacgacgaaacatcacattggctgcctgaaagcggcccaaaacagccgttatctgattgccgatgccgcgctttatacccaagagacactggcctcacttcatcaacaaaatcaaaaatttattacccgggttccgttaaccattaaagaggcgaaacagcacctgctgacggttaataccgaccagttacaaccggttacagaaggttatgccggtcattggattgaatcttgctacgggggcgttccacagcgctggttactggtcaacagtgaagcggcgatgcagtgtgaacatcagactttcaggaaaaatacgcggatttcgacggaaaaagaactgaaacagttcgaaaaactcagcaaaaagtcgtttccctgtggtgaagatgctttgcaggcattgtgtgacttcgaagcagaatgccagtttatcggcattgaggcccccaaagttcaaaaaatcgaggtgcataaggggcgaggccgcccggctaaaggtcaacatcccgatagtgttcattatcagctttctgcctcggtctacagccaactggggaaagtggcttatgtccgcctcaaagtcggcatgttcattctggcgacgaatgaaatggacgataaggcgctgaatatggaaactctgctggctaattacaaagcgcaacaaaaagtcgagcggggtttccgtttcctgaaaagtccggagtttctgacttcagcgatttatttgaaaaagccagaacgcatcgaaggcgttattaatgataatgacatgcagtttaatggtttatgctgcactggagcataaaatccgcaccggactgaagcaaaatgccccgttctatcccgatatgaaaggtaaacccacccaatctcccacggcgcgttgggtgtttttgaccttcgaagggattagtactttcgagtttcaggaacaccgtatggtgacgggaatacaggtgtatcaaaatgaactgctgaaaatattggggcaaccctatgaatcattttattcctgaaagtggtgcggaatgtcggatctattatttggaacagctatttagtaaataagctttcaaaatgctttattaataacgactaaattctgacagagaaaattacagggcacgacagcgattgttaacaaagccttttggctatgttacaatcgacgtacttaagggcgttcctcccctaatacccccgcgaagcggctttaattgaaaattaaaggagtctctacgagcctatggaaaacaatgcacttaaaacagccgcttttagcataatgaagcctttttgttattaataaaaaatccacttatttttttattccaaaaaaattaaaacagaaaaataattagatattttaccaaggactttaattaaaaagccctcgcctttttaaatggttttaaaatcgttttaattaaaaattaccagccaatagcaaaaccaaccccgaccgcagaattactctcattatcccaagagaaatttaaacggacattcgtatttccagtgggtttatatttagcacccgcagcaatagcattaccgtttttataattatctaatcccatcccgaaagaaaaacgttcttcttgtacatacggaattgaagaaattgcggtaacacctgctaaacctgcgttgactttattttctaaacgatcaatacgcttatccacttgattaaaacgtgaatctgttttgccgtctaactgattaaaccaataatcggtataatcattgcttgttgaaatcgcttcattttttgcattatcaatattttcattgataatgatatccgtaattcggctatcagtgtaattattactcgttgtaatcgcctctttcttcgagttatcgatattctgatttaactcagttttcctatcagtaattttcaaatccgtatacttattactggtcgtaatggcttcatttttggcattgtcgatattatgattaatcaccttattatttccggtgattttgttatcagtataattatttgcaaaattcagagtttctttggctttgctatctgtataggcattcgcgttcttttcagcagcattggcggtttcttgccatttttggaacgcttcatttttcgcattattaatattctgattaatcaccttgttattttcagtgatgtttgaatcagtgtaattgttagcgtttttttcggcttgctctgcgcgttgaaaagcactatcagcttttgttactgcattattagctgtagcatttgcattgttagctgtattattagcttgattcgcagtgttttttgcttccgtggctttgccgtctacaacatccatctgacctttattaacagcatcatttttttgtgttccgtcggcaacattaacaatttgtttttgattattactattaccaaaagagactgtgttttctctgtcggctacagattcattaccaaatgccatcgagttatttgctttggcttttgcagtaaagcccatactgatagagttatctcctgttgcatgtgcgtgattacctacagcagtagatgctcttcccgtagcattagccttttctcctaatgctgtactttcccaaccggaagcaatgctatcagcacctaatgcagtcgaaaattcgccagttgccacagcgttataaccaataccagttgatttcttttcttgtgctctaaataagaattcaaaatagtagatcacttgagggaactcagtccgatttttacgatctgatcaatggcgaaaatcacaaatcactaaatggactgagttatgcctatcatagcacccatacctcgaaatgaacgacagaaaatgaaaaagcttatccagaaaacccaaaataaggattatgctcgccggatgatggcattattaatgttacacaagggggatacggtttctcacgttgccaaaaccctttgtgcctcacgttcttcggtcaatcgctgggtaaattggtttacattatatggactggacggattaaaaagcttaccgccgggcaggccggccatctggaatttagagccacttctcgctgtggtttctttcttattaaaacactccccacaacatttcggttatctccgctcacgctggagtcttgagcttatcacacataaaatcaatgtattactggatatatcactctctcaaagtacactttatcgctacttttatcgggcggggatcgtctggcgaagagccgcacccacgttaagattgtctgatcctgaacatgatgaaaaaagggcaaaaatcaccggggccttatccaatgcctcagagcaacatcctgttttttatgaggatgaggtggatattgaccttaacccaaaaatcggggcagattggtgtttcaagggacaacaaaagcgtgttgtgacccccggaaagaaccagaaacactatcttgcgggttgcctcaacgcgaaaacgaaagaaataacttatgtcgggggcttaagaaagaactcggatttatttattaagttgttagatgtacttaataatcaatatgttaatgcaaagacgatcaccttgattttagataactatggcattcataaaagtcagaaagtcatcgcgtggctggcaaaaaatcctaaatttaatctcttgtttttaccggtctattccccttggttgaataaaattgaacgcctgtggcaatccctgcatgaaaccgtgacacgaaaccattgctgccaatttatggggcagtgacttgaacatgtaaaagccttcatggaaatcacttcattacaacagcaaaaacctgggagggtaaaaatgggtgtatcatcattatgaattcttatttagcctgatcaccataaatagtattatatgaagcataagccccgccaattcctaaagttgaagataaaaccaaaacaataagttttagcttaaaaccattacagtatttttcagatttattcttaaggttggattcatttttttgtgctatactaattttgttagttaacattaaatcaattcactctattgttttaaaaactaacggctagtcatattccagtgtgactaaccatctaactttctttttgttgcatccaaaaacacaacagtttcaattcttcggcttttgttcgattactacctttcactctctcctctagccataaatgagtgcttaatggcaaaactaagcttatccatttaatatttttggtatgcccttggtacagttgttcatccaatccggttaagtcgggatcgattttcattaattctgtagcaaggactttaatttctgcgcgttttgcccgttcattcatcttcactctaaattcctcgacattaacatcaaccggttgattcattttatctttgatagttaatgtcagtttctgcgtacttttgccctctgccgccaattcacttttttctggtgaaaataagctattaaccgtattgattgcagcggatgaaacaataacctgcatatgcacaggattagaacgattgccttttttatcaatggcaacggcagaaacagaataggtattcttgaccttatgatcaccagtcgcagccacagaggtagggtcggtgtgactgtattgataatctggcagcaaaatacggtaataaccgccgtcattttcaatcttgccaccattggccgttaattcagcaagtttccaatcaatgcgttcaaggccatatttggcagaaaccgaaatattcagcggtttttcttcaccagcatagccgctgattgtttgatccaagtgaaaccagatgacctcttttttctgatattccagaacaatatggttattacggtcaactaggctgcgtcccttaattagataaccgcctgtaaaagagtcgaatacagcctaatttcaccctggacaaatagtttcgtgcggttttttcgtaacgggttgcgatacgccgatttcctttcagaaaaccgaaacagcgttcgacaacattgcggtcacgataagcctgttcatcaaattgtgtgcgaccatcagcactgcctttttcattgattttataaggaataacgcttttgatcctcaatttacgcagataaccgcggagttttccgcccgaatagcctttatctgccagcaccgctttgccacgtcgtttcatgaaaccatttttgcgttgtataccaatgccgtcgaacaaagggatggcggattgactttcatgagcttgcccagcggtcaacatcaggttgaggggaaaaccctttccgtcggttgccaggtggattttggtgccataaccaccgcgtgagcgacccagcgcatgatcgtcagtgatatcgggatgttttttttcgcgcctgcggcatctttactcgcgcgaatattgctgccatccaggcaaatttcagcccagtcaatcaagcctttttcatccagaatggacagtaaccgattaaatatcttgttgataatgcccgattttgacccgcgattaaatcggttatagaccgttttccaagaaccatagcgttcaggtaaatcacgccacggtgccccggagcacaagacccagaacatcccattcatcacacggcggtgttcaacatgtggacgtcctgctcgctctgaatggatcgggggcaaacaaggttctatcactatccatgcgtcatcaggaatgtcgtagcgtgccatcatctttttcccatattgaaaacagtttagatgagaatactatcaatttacattaagggacacagcctaatactacagccgtaattgctctgtaagccgatgatttccccggcggcgacagtgacattgttgtgcccggtattgatgccgtcgtcgccagtctgaccaatgtaaaatctgttcgattgtctttcccgctttttccatcagctttgacagcagcttacggagttccgctacactgagcggaacccggcctaccggtgttttttttctcctgtacccgcaaaaccgccaggactgcatgggccagtaacgacaaggtaatatgccggtgccagctctgccatcgccgcacttcgtagtgatccagcccacattcccctttggtttcctcaaagccactttcgatttcccagcgacaacccgcaacctgaaccagcgtattaagatccgcctgttctctcagggcatacaccacatagtaagcccgttcctgtctgctatcccggctgcgccgaactaacaaataatgaccataatgtcgatcctcttcactgagctgtaaacgccataacggcacgacagcccagtcatactcacgctcaccttttgtccccgttcccgctgaccgtgttttccagtcagcggcggtcagggtatcggcaatccggtcagcacggatatactctggtccttgccaccataagggagtattgcaggggatggctaacacgaagggctggtatcgggactccagccagactcttagacgacggtcacggccataaacttcatccgcggtcacccagcgacagggaacgccagcatcccatgttcgttccagcctctgccgggctaactggggtttcgttgcaaaagtgacgccggcagggatacccgcagcttcacagcgggaacgggcatctgtccactggcgaggcaggtataatgcccggtcaacaaaggcatgccctccgttgccggcgtaacaaagaaatacgcctatctggctgttttctacccgtccagcggtcccactatactgacgctgtaccccggcagaatgtgtcccttttttgataaaaccggtttcatcaatgatgagaacaccctgttcatcgcccaaatgttcagtgacataatcccgcaggatatcgcgggacatatcgacatcccaatcagcgcgttccagcaaatattgaatcccatcgggggtactttcccccatccattcagccagttgccagctattcttacgttcaacatcactgagcaatccccgaagataggcgaggctgcgttgtcgtgagccggtagagtgaaataagggaaccagacgggtatgtaatgcctgtagcgcctgttcccagattttggcaggggatggcatgtgacaccgccttttatttaaggaagaagagccctatcatggcacatgatggattacggctgtagtactagctcttgtttatggcttttccattcgctgagcaattccggtggtatattgtcgcgcgtggtccgatatttcagctggttattgacaacaaacagcgtgattccatgttctaaagcttcattgacgatttgtacggcagttttcatatatcaccttctaatagtccttgtgtcgtttcttgttctatctggaaatgttttcatttttctttgacaagaacatcttaaactccttatttttatgaaggaggaaaacacataaatgttcccaaaatgtatttatacagaaaatgaagtattagataatatatttttaatctattacttttttaatatagggaaatagaatatctatattttagatgcacaatattcaatgaatatttcttggtgtgaaaaataagataggactttagtctttaaatgaaaatatttttaattataatgagcagtcatggccataaatataatattaaaatcattaacattcatactaacatattattgttattcgtcgtcatatacttttttttatttatgtatcaaaaaacaattaaataaaaatatttttattaataccctcagatataatctattacccttttattttatgaaacatcatcttatgtcatggtaataaaaaaagagcttcatgtatcatgtaataacacgaagctcttggtgattaagatgatgctattcgttataaggctcgaaggattgggtctacgctatcttgctgaataaaaatataacctgaacataaaggatttaataagtgtaaaaaccccggccggattttcgtcccaaataacccgcatcaaccattgtccgcatcagcggacaaacccgatattttgaatcctgaaacatctggtagagcacatcaagggaattgaccaccgtgtcaataccaatcagatccgctgtttcgagcggccccattttatgaccgaagcattgtttaaagatagtgtccacatccgcaggttgggcaatcccgtcctgtatggtgaaagcggcttcattcataaataaatgagaaatccgattagagacgaagccggggccatctttcactaccacggcgtttttacctaacaccctcaagatttccagacatcgttctttagtttgttcggaagtattcagaccgacaattacttcgacagtatgcttcagataaaccggattcataaaatgcacaccaatcacttgagaagacgttttatgaaacgaacccagtttcgtgatgggaatgcaggaagtgttcgccgccagcaccgcgtgaggggccacaaactcagacatacgggcatataacgcctgtttaagctcgatattttccgtgatattttccactataaacgcacaatccgacacggcttgcaaatcctgcgaccagacgatgttgagcagcatctcctcaggggtttttcctttggcgagcggactgaacaaaggcgcgtaacccgccgtttccatgatgcgttccctgctctgttcgcaagaaagagcgtctttttcgataacaacaacatcatgcccctgcaacgcacaatcgaaagcaaggctagaaccaatatttccgccaccaaccacagctattttaagttttgacatagtgactactttcttgttgggttttaaaaggttgctatttcaggttcacttcttggagcacaggcactgttcattcagtcgaatcaggagaaatcacttcccatttaccaaacagcgtcaatcctgccgctttagccaatgacgtagacgcatagttatcgagctggcagcgatactggggttcatagccctgatgacaggcatatttactgattgaacgcaccactttgctggcgtggccttttcctctaaagggtgccagcgttaatacgccaagatccgcaatttgcgcattctcccacggatacatactggccgcgctgaccagacgatgctgttcaaaagagccgaacaccgcccagtgatctaattccacataagcgtcatccaaatcttgttctgaggcggaagattcgaattcggagaaaaccgccttatcttgctctgttaactgacgcaaaacacctgccagattctcttgcagcaaggcgttcttatccgcttctgaaaaataaaagatataatctgcgccatgcagcgtgacgccggcttcattcaatttctggcggaaaaccggctcagacagatcttgttgctgataaagaccggccttatcagccagcgcgggtgtcagaaccgccatcactcgaccgtcggaggtttccagcaccatgacccggcgatcttcgttcagatcagggttgacggtaacagtaaagactgcatcgctatagagaacgtctccgttcaaaaatggagcctgccaaaaatcagttattgtttgtgaaaataaaggcatacttcttactcgctttggttggaatcagcgagcgcacgatggcgctcagtcaaataaccctaggaaagacaagcggaagtttgagctacccactcccttgctcgctcttcaatctatggtatcacttcatcacgtgtaaataggcttggcaacttaacacgggcttggtcaatctggacagagccgccagcaacagtcaaaactaaagcctttggttacgttggtgaataagggcgaattctggaacagccgcaatcggtgcattcgctatccagccgtggccgcgctcgcgtttgaaattgaagtaatcacgatactccgaattagtgacaaagttataagtcaaagaaatactcggcgataaggtatgcacttcatgggctaaccctttggggatcagcataatctcacccggtagcaaatcgaattgccatatacgatctttgctgtgtggtgaatttgcctcactttttccattagcggcgggtgatgcgacggatgataaagcagcacgaccctcagccgtatctctgaccacatcttcaagcgaagcggaaaagatccagcccgcttttctgcccgcgacctgacacaacaccgcattggtgcgcataccatcgacatgtaaacgggtacaagcgcccggcgcagaaaaatagagaccccaatcctgacacatccgcttgttcggatgcagggaccctacctgaacccaagggatcttataaccgccatccggcagaaaataaggtctgcgccaatgctcctgaatgcgttgaaacgccagaaaactgaacgagttggttttcaccctgtgaccaaatccccaagtgaacagcaggtgcttaaaaaatgaatcgtaggtgtatcgcagatagctaagattattccccatttcgcccagttcgacggcaggcaatgacatgatttcccgcaggtaggtgcgcagctcaacatggtctttcggcttgaatcccgcatcctgcaattgcacggacatatccccgaactcctgacaaaagtaatcaaagttccatatttgcttcgctcgccagcctctcagaccatcagcgataataaccggctcttttttcattaagtagcgttcactgaactcagcgattgaaatgtccgaaactttctccaccttgcgatattcagccgcctcaaggcgcgctagtgcatcgttatcgttattgccaacttctcgctgcgtgccctgccggcaccgataaatgctcatttcttcgaacgcccacatcgcgacatccccgaatgcattccatgtattactgaaaagactcatctttcgacctcccctaaaaattaaactctgaatccacattctggtcgctcgtctgagcgaacgtttccggcgtaggctcaccgctaaggttcttgagtaattcctgtatttctacatcaggatcggtgagcacttcctctatcaaagcgaaaaagtactcaaacagcgccataatggtggcttcgttaaacatgcgtgcacgaaattgtatcgtgcagtcaaatgtctcttgggtttcggatatttccatcaccaaatcaaatttggccgtatctgacgtcagttccagtcgggaaaatccggggcgccacgcggcttcatcagcaccgttcagactcagtggcagatacccgaaaaccacgtcgaacaacggatgtttgccttgacggctttggaagtcatgctcagtactcaaatcgtccagcagcgcgctcatcggataagtctgataagggacgctttcagaccactgtgcattcagctccagaagatagtccgtcatggcaaagtccgcatccggctcaattttcagagccagcatgttgacaagatagcccaccagcgccagttcttccggctgtgtgcgtccggtgacgggaacaccgagaagaaaggattcggcgcgggcgattttcgtcatcagcaccccgaacgccccaaggaaaaaggtaaatacagggagccccagatcactgcaaaaacacctgatttcttcactggtttgcgcagaaaaacttttaactcgcgttaccccccgatggctgtcggcatcgatatgtccgtcataatcatctaccacaggtaatgccagcggtgccggcaaaggtaatagattggcgagccaataagctttatttttccgtatctgatcttcactctcaaactccagcctatagcgccgataggcagcgaaactgtactccggcgcaggtaacgggcgctccttaagcctattctgaaaatcatgggcgagtatgcccagagaaacagcatcgcatacgatgtgatggacgacgatcaacacctgatgaaactggccggcatccgtaccttttatcatcatggcgcgcattggcagttcggtatgcaggtcaaaaggcgccttagcaaactgttcgaggcgagccagatttccctcctgtgcgggttcagcctcaaatatggctaagctgactttagcgtcaagctgaggcagcatcatcaaattagccccctgccttttaaacagacatttcaagaccggatgtcggtctgcaacctgttctatcgctgtagcgatggcgatcgcactgatcgccgccgggcattgaaaagccattggcatgttataactggcgtcggtaaacgtggtttgatgtatatacaacaattcttgatcggcgctggcaacgattggctcagatgggtcgatggccggcaagatcggatggagcgcgttctggtcgttgagcaactgccgttcaatctcccgtaaggtgggttgcgcaaaaaagtcctgaatggaaactcgcttaccgagttttttatacactttttccgccatcacaatagtcttcagactgtcgccacccagttccataaatcggtcatcaatgccgataccgtcaataccgagaatactgctccatatagcggcgatttccttctgcatctcattggcaggcgattgataaacggaagtcagcgttttcggtctggacttcaatttgacgttcccctcggcctgcggtctgtgatcgccattggcagcacgtcttcctccccaggcatacaacctatccataaactggccagcagagaaaattttctggttttcgtgatcgtattcacgcaaactgcgttcaaacagagcaggaaactcagcgccagagagagcaacttcattagcaccccagacaagtgcatcagcccgacgatcttcgtcaaaatgtaccgtttcccagttcacggcaacccaacgcgtccctgtcaaccgtctgttttgcatctgcccccaaccatccagaaacagattggccgcagcgtatggcgcatgggcaatgcccccgaaaaacgccgacatagaagacatcacgaagcaatactcaacaggaatgctttcgaatacgttggcgagtactgccgccaccttagcttttggcgcgagttgcgcgcaataatgatcagcattgagttgaaccagaggagaaaaagaattgccatcagtaacgccggccgcgtgaagaaccacactgatctctcccaaacgatggcgaatggactcaaacaacgccaatgcgtcggcttccgattccagagcatacggaaaaatctccaccgtttcagcgcccgcgtccttcaactcttcctgtaagcgcttcatcgcgggagagtccgcaggctggcgactgattagtgccaaccgcccttgaaaacgtcgtgctatcacccctgccatcgccttggccatcctgccgccagcgcccgtgatgacgtaagttttcccggtgaaatacgacgcatccaacacatcattttcttccgcatccggacaacgaaaatcttcaacaaacagcccctcgtcattaagtttcagaggcccatgcaacggagtctgcagcagtctggtcagcgcggcaggcgtccaatctgcactgggattctgaatgcccagaaacgcacaattgacaccgggaatttcctgaggcatcactaacgctaacgctttaagagccgcagccgtcaatacagattcagccagagatccgctatcgccggtcatggagcaagcgggcgcgatcaaataaatatgcacggaagtaaacgcggagaaatcagtctccgcgagcgaccggcctaattcagataagatttggagcgacgctggcgcaaaagaaaaaccctctgtcgggaacgccagcgacaacaccagagaaggattcttttgcaaacctgttaattgcgaaccaatagacagttttgccagagcacttcgcacctgtactggacacagcatatccagactgacaacctcaatctgacttttgtctgccaacccgctcgcaagagacgctaacgtctggtcaaccagcagcacggcatccggcttcacctccgacatcggttgtgccggcaagcgtagaggtttccagaatggcaataacagccccgccgcatttttagacagatttttgccatcaggtgccgcgataacactggcgatttgcgaccagattttatctgtaatatgttctgttccgtgttcctcacgaataaaagcgtatccgggaacatccatcaacagttgtccgtcacaggagcggaaaagacatttctcaagctctttcgtcttaccagatacccagtcggtgatagcagcaaaatgttctgagaggttatccggcgatgtcgtttccagaacttgccgaaccagcgccagactctccatctgttcatcaggtgccagatagcgttcaatttgccgcatcagagcaaacttcgaatctgctgcaaacacagctcgatacggaaaactgtgccgcttgcccaaggtacgggacagcgcagataaattcggatcagtttgcgataccaaccactgggacactgattctaattgcagcaccagagaagcactgtttttcgctgaaaacggaaaaaaacagacttcgggtactttatcgacgccgcttgtcttcatggcctgcggagggagcacatattgctgtaacaccatatgcgcattggttccgccaataccaaaactgctgacgccaccggttctcaatttcccttgttttgacggccacggttcagcacgggtattaacataaaacggggagtgttcaaattccaattgaggattcggccgttggaaatgcagcgtaggcgggatcatgccgtgtctgagagccaacaccatcttaatgaaacccgcgataccggcggcggaatccagatgaccgatgttggttttaacggcacccagtgcacattgattgagtgtctcctctgcactggcagaagatcctctttcgttgaaaacttcacgcaacgccataaattcgatgctgtcacccaaagaagttgccgtgccatgacactcaatgaaatccagatccgccgcgtcgatctctgccatctgcaaagcagagcgaatcacttccgtctgccctttaacgctaggcgcggtgtagccgaccttgcgggcaccatcgttattaatggcagagcctttgaggatcgcccagataggatcgttatcagcaatagcatctcccgcccgccgcaatactaccgcaccgagtccgctaccgaacacgctaccggtagcctccgcatcaaacgctctggttttgccgtcttttgaaaataacattccgtcttgataggtatgcccgttttgctgcggcaacaacagactgattccgccggcaacggcgaaatcacactcaccactcaacaagctctgcacagcctgatgcacactgaccaaactggttgagcaggcggtctgcaaggtaaaactggggccttccagtcctaacttccaggagattagcgtactcatcgcatctttattggacaattgggaggcaagaaaaccgcctacattctcaacctgttcagacaacatcgcctgcatcgtccactgcaccgaactgcgcgcccccagaaacagtccgatattgcgactccgtttgtcaggatcgacgccagcgttctccaaggcatgccaaacgcactccatcatcaaacgggtttgcggatccaaaagcgccgcttctgcctgactgtagccgaaaaactccgcatcgaaatactgtgcgccttccagtactccgttaaccggcacgaaatctttattgcgtatcttgccggcatcatgccctgccttaagcaattcttctgccgtaaagcaggaaatcccgtccacgcccatcaacaaatttcgccaaaactcactgcaattccccgctcccggaaatcgacctgacaaaccgatgacagcgatatctaaatcttctcttatttctgtacgcataatgtcttaccctgttccagatcgataaagtcatcggaagttaattgcttaacgaattcaacgtgatcaccgcttttacgccggacggtgcagcaccctttcattttttgcgtaagtccatcaatacctgcttcgtctgcgtcgtcggaaaagaacatcgtgacggggaggttttctgatggcagagccaagatccgctcatggaatgtcttgttttcaaggatctgatgctgtaattggtaatagcgccactcctgatggagcgaaggaaattgccgccgcaatgtttcaacatccatatcggcatcaatacctgcacaatcaaaagccaaccgattaacgtcgcgaaagaacgcaacgaactctgcatacagctcatctccctcaaaaacgttggtacgcaggttaggatcgagaaacactagtttgtctatgtattgagaaaaatgcggcgatgactccgattgttgtgccagcaatgccaccagcatctcagccccaagggaatagccgcccagccacagtgatcgtgacgggtgtatgtcctgcgctttaatgtgcaatgtcagagcatttagcaacgcctgtttaaattcctgcactgacaggttttcaaccgcgcggggctccgttgttaaaacagacacggtgacgcgaccggctaatttgtccgccagcgtctgcaattcaatcaatccccctagcgccggcggcagcagtatcagtttggcagtgcccggctcatcgacgttcagaaaacgctcttgtaacaacttcactggcattgtgtcatccgctccctgccgtgcgttgatcagcgaccattgctcgccgagcgtggcattgcggaacacatcgacggggctgaatgtcacgccgaacagagtttccagctggttagccagtcgcacggcactcagggatgatccggataccagaaagaaatcagaatcctgtgtcaacgcccctttatatcctaagcatttcctccagcaggcgattaacttctgcactccctcgctcattgttgctgcctgctcctcctgtgtttgatgcgtgttttcacgccattccagaaacagcgccacgatccgctgccgatccagcttgcctgtttcggttcggggcaaagacgccagcggaaatatcgccgacggcaggtgggagcggggataatgtcgcgccagatactgttgcagatccgactgcatattctcttttccttcaatcgccagtaccaaacaagcttccggtgtgccggcgaacgccactgcggcacccgccgcaatcacgtcagggtactgtccggctcggttttctaattcacccaaaccgatgaaattgccccgcactttacaactatcatccattcgccctttgaggtaaaacagaccgtttttgtccgccatcgctaaatcgccggtacggaaaaacgttccctgagcgtcccgaccaaatttacgcgcagtcagcgccggatcattcagataaccatgacgttcaaaatccccatagatcaccagttctccccattgaccgacccggagccggccgccatcctgattgatcacggcaaaagcggcatgatcgaagggttctccgatggaaagtgccgtgcctgacgccaactgcgcgcagttcaccatcgatacggcaatacaggtctccgtggggccataactgttccaaatttgtgtgcgttcaagtaattggctgatatctccggcagtgaggaaatcaccgccactaatacagatcttgggcaagggtgccaacgccggcatacggttccaagcggaaaaaagagccggagccgcagaaatgacatcagggcgatagtgaagtaaaaacgctctcgctttgcgttcatccagtaaactgtaacggtcaacgaccacactcgttccttgcaatgcccaagagagcagaacttcttcgagataaccgtcaaaactgggcgagaattgctgcacgatccgcaatccctgctgcgttgcctgcaattgttgctttaatcccagtttattgacgagtgaatccacatactgcgccgctgtatgcgcggcaacgcagatgcctttgggtttgccggtagtcccggagctgtacagtacccatccgataggattatcgtcagcggatttcatgctgtgaaagccgcgccaattaatggaaacaggttcaatcagactatcgtcctgcaattgtgcgccaatttccgaaccgcacttgatcacgagatccggctctgcatggcggatcacctcgttaatacgttcctccggtgtccccgtttccagtgccagataggtcgtgtgcgtcaggaaacacgccgccagaaatgcctgtagctgacgcccctgacgtcccaaaatgagtgcccgccgaatcgtcccttggtttagaacctgcgtatacgcagcggttaatgcggcgaattctccccaagtcacgacgcctttttcatccatcaccgcgggacggtcggtcaatgtcagaaacccattaatcagcatggcatcaatttggcgatacgacgcgcgtcgttgaactggccgaaaggcctttttaactatgtcggcagacactatcagatcatcaatctgcaaggtggaaggaacgtgacgcaatatctgccgcaaaatttcctgatagccggttacgatcgcttctatctgtgaatctgtgaaagccgcgatctgatattccagcgtcaatcggcaactttgtgtattttgtataccttgcgtacgatggctgacagtaagattgagcggcccatgcgcttccagcaataaatcctctgcatccagtgcctcattctcccctgcgtcaagataggaataggcgacattaagcagtggattacggccaaacatcctagggtcacgactgagcaatgcaaaggcctcttcaaccgggaaaaagagctgatcaaccgcgcgccactgctcatccgccaatttcttaataaatcggtcaaaggtttctgccggctgatcaaaacgaaacgcgcaaggggataacgagacgaacatgcccactgtctccagcgcattttttgggcgaaatgcattcgccactgaaatggaaaaagcatcgctactcccttcgtgcgccacggtaagcccccacaccgacaggaaaagcatggccggagtcacgttgacggctccgcaaagacgtttcactgctgccatatccgcagccgatagatgccaggatagggtttttaccttgccgcctgcattcaccgcaccatggccgaacggatcgaactcaagcccttcaagatgatttgcccagaatgtctcagcctgtgtccagaccgggtgttgacgggcatcagccaatgccagcgcatagtgcctgtaactcagcgcaacgggagccaacgattcgtgcgccagcaattgctgaaactcacgctgtaggatctccaacgaaggtttgtccactaaaatatggtggatctgcaactgcaagccggcgtgctccgtgttcatttcctgtagacagcctctcagcagaggggcttctcctaactcgaaagcctgcgtccgcctctgcaaccactgactccgatcatcgatcagtaccctgtcaaccgagagcgacggtaatatctcagcatagggaataccttcactatcgatgcgatatcgggtacgcaaaatatcgtggcggtcgattagaacctgtagtgtttgtttcactacatcagtagagaggtcatgagataacgggatctccagcgccaaaatataagccaatgattctggatgcagacgatattgtgcatagagccgaatttcttgtgccgataacgggccacgcccgccaaccgcaagctgaggtgcggcttccagcagacttgagaaatcctccaccgccatgctgtcaccgccggtccgtcgggcatcgattgttttcgccagcgactcgatcgtatcgttttgaaagaattccaacaaagagacaacctgcccgaattcatgttgaatttccgccagaactcttgccgcccgtaacgaatgaccgccaagggagaaaaagcttttgtccaccgacaacgcgtcaacctccaactccaaatagcgtgcccaacaggctgccagccattcttgagttgcaccgtcaggccgaacgattttaccgctcatcgccttgctgaacgcctgttttagcccttgtcgatccagtttgccgttgcgtgtcagcgataattccacgaccaaaataacctgactcggcaccatataagcgggcatccggcttaataacgcctctctgatgttttgctccgtgaccccactgtccgtcgtaacgataaagacgccaagatgagcgtgtccccgctggtcttctatgccaatcactgccgcttgagccactgtcggcagatccagaatgtttttttcaatggcatccaattcgacgcggaaaccgtttactttcagttggcgatcacgccttccctcaatttcaatttcaccctgaacattccagtaacagagatcaccgctgcgataatactttcccttcaaccattccgtatccaggtctacgaacacctttgcggtgagatcagggcgatttatgtagcccactccaacgccagttcctcctatcaacagctcacccgctacaccgataggacagggttctaagctatcgggaaataccacgacacactggcagccgcctaacggcttaccgatagtgattttctggttattgcgtactaaggataaataggttgtgataacgccggtttcgctggggccgtatacattaaacagctcgtaattattcttttgaaacgttctcaggctttcgccgccaaaatacagttgccgcaagttcggaatatcccccagctccatgatgtattccgccagcacggtcgtggtaaacaataaatcgatgcggctttcccgcagaaatctgacgcacttttcagcgtctgtacgtacctcttccggcggcatgaccaacacgatgtcctgagtcagacactgcacacattccagtacgaaatagtcaaaagtatggttcgctacggaggcgactctggagcctgccgttcgatacagggtttgtttttcagcactgagattaagtaatgcttgatgagtattgatacaacctttcggtttaccctcactgccggaggtcatcaccacacacaatgggtcgtcgggattgactgcctcacctttacgcaacaacgccgccagagcagacatctccgtccgatgcgtcgacttggccggcgcatccggtacataataaggcagcatgacaacctgacagccctgagtgcggaaaaactctgccatctcaccgcaactttcctgtagcagaaccaccttggtgctatgcagctcgatgatgtccactaactgcctttctggcgcgctataggattgcaggcagaacggcttaccgatgcgtatacatgccattgcggcaagtgtggtttccacgcccttggcgccgacaataagcacacagtcgcctaacgattcccattgtggcaaatcaggatcagtcaacaaattatccgtgtaccgctccaacagtttaaagttaacggtctgatcactggcctcgagaaaccgggtttcagctctgccgcgcatggaggcggtcatagcctgtgccacatttttgtatctcagtggctgcgcgggtacgggggcagaaagtgcagcaacacgctcccgctcttgatccggcatccagggcattgacgcgagcggggagtttggttcgaataccatgctgttcaacaacaaggtcaagcgatctatcagaagtgatgtcaattctgcatccaccctctgcgaatcgaaccgcatatgcagacaggtcttttcgggactggcctggagccagagactcagtgaataacacgccgtctctgtcccctcaaaaggtggctgagtttcagagtaacccgccagaatttgcggcgattgagacatcacggaagatgccgattgcagaggtatgccagatgtcaacgcagcaacttgcttccattgcgcaagctcctcaccgaacagccgttttacgggttgtgtcagttccgtttccgtcagatgccatttagcggggacaagataaacacctgcggaacggtcatcggataaaaccgccggtgttccgttccccgctatatcttgcgccccgatcgcccaattcaggctcccttccggctcccggcagtgcaaaaaagcgagatacttgatgcaggcggaaaacagcgatagacgatgcagcggagacgccgccatagtgaaaattctgctgttcagtggttcggcaaacgtgaatgacgtcgtgaccacctccgtgtctgtccccgatgtcgccagccgtgtcacaaaaaagggacatccctgatagtcggtatccagttgttggcgaacataatctttgaatgcctgtttccttgcattcatcacaatgggatcattagtgtgcatttccgcaacttcctgttttattttcatatcactcaacactcagcgcactttgcaaaatcgacttaaacagcgcttcccaattccctacgtcgcttctcgttctgaacgagagcgcttccagatgaacgtcaaagcccgtggtatgctcggcaatttcgcaggtcagattccagtgcgattgcccacctgcaacattgggcgtttccaattgccgacagagcctgcctgcgatgcggccgtcaaagccctctttctggaagtaaccgaaaaaggacgtgggtgacaacgcctgtttagccagcgccggataccgtactgtcaattcttcgacatcaaacaggtaatgacgacaggccgcgcgcacggctgtgctcacttcatggagcatctccggttccatcgtctcgccccgcaaccttacccgcacgggcagaaccgacatcaatggcgcgatgaccgtctgctgatccaacctgtcccgaccatgaaagatcatggacgttagttgatcgtgcgggttgaattgagcgggctgataatccagacgggctttaaacagcaaaaatgcggccatgaagaattcaggaacactgattttcaatcgtgacgtgagcgtttcaatctgccctttaagcccgtcgtcgagcgtaatcaggcaagtgtgcgtgactgactcagtgtcctgcgcatgcacaaggggcgaccactcctgtaactgcgtccgccagaagtccgcatgttcttgtcgcagagccgcaaattcacggctgtagaaaagctcagaataagtcgccagacgggttcccgaaggagcggggtcattttcagcggctaactcgctgagtatttgcatcagacctgaaccatcaatacaggcatgggaaaaatccaacagcaaaagcggatgccgcccatcaacaacccaccgaccgcgaacattcatgccatcttccagcgaaaacgggcggataaaatcgcgcagatcctcttccagagaaccaagagtttgacgtttctccaatcggaataaaaaacgcttggcaggacgcaaagagagttcatcgcctgtaagaatgaattgcgccctgaggctttcatgacgggaaaataccgactgcaatagattacgcagttgtttaagatccggctgcgcatcgtcgtcgaacgacaaagcgaggaaactgttattgcttaagtcttgaggattaagttttactgccttgtagatggctttttgcgttggcaacgcccgaatctgctcgacaggcgtcggttcgttctgctctgttaagggcgcccgatccccattttcccttgctgcgtttcctttttctatttcagtctcgataagctcggcctgcgaagccaaatccaagtgttccactatcgcactcagcagcaatgacacactgaacgcttgctgtatccgcgccatgagtgcaacagccagtaatgaatgccctccggcttcaaaaaagtgagattgacgtccgatcgcattagtattgagattgagtaactcggcccacaattgagccaatcgggtttccgttccttcctgcggaggttgtgccgttattgtttgccccatcggtgcatcagcaggagatggcaacgctttgcgatccaattttccattcgtggtgagaggaaacgcatccagccaaagcaagttggacggcatcataaatggaggcagattcgtctgtaagtgcgctctcagcgtctgattccgttcctcctgaacctgatcggcgtagccggaagcaggggtgacataagcaaccagacgagcatcgcccggcacatcctcacgcaccagcaccacacactctttcacgctgtcgtgcgataacaacgccgcttccacttcacccaactcaatacggaaaccacgtaacttgacctgaaagtcattacgtcccagatattcaatgtcgccgccgggtaaataccgagccagatcccccgttcggtacatcacgccatttaacgccgggctaaagggatctctgatgaatttttccgctgtcagttcgggctgattcagatagccgcgtgccacgcccacaccggcgatgtgaagttcacccgccacaccgaccggacacggctggccgtaagcatcgaggatataaagctgaatgttatcaatcggcttacctatcgggatcacattttccgggatcaagccatccgtttcatcaaggcagcaattccaggcggtgacgtcaatggccgcttcggtcggcccatacaggttatgtaattcgactttggcaaaacgctcccgaaaccgatgcacactgcgcgccggcagtgcttcaccgctgcaaaacacgcgttgcaggcaatcgcccacttctgacggagcctgatccaaaaaggcggataacattgacggtacaaaatgcagggtagttatccggtgcgcttggattaaggcgctcagataagccggatctttatgtccttcgggctttgccaccaccagacgggcgccgtacatcaggggccagaagaactcccaaacggatacatcgaaactaaagggtgttttttgcagaacggtatcatttgcattcaaccgatacaccttttgcatccataccaaacgattgacgacgccaacgtgctggttcatcacgccctttggccgcccggttgagccagaagtatagataacatacgccagatgggaagaagtcagaccattatccgccggatgcaaatcatcactgttttgcccggaccactgcgagacatcggcctccaaatcgatcacgctgacatttgtgctcatcgcgtattgatccagcagcgcgcgaacgacagccggcaccgcaccgtgagacaacaaagcacggggagcagcgtcatgcagcatgtagtcgagcctttcagcaggatagtgagggtcaagaggtatgtaggctcctccggctttcagtaccgccagcagcgcaaccaccatttccatgctgcgctctacgcacacgcctaccaaagtatccgggccaacgtgcaaatcgtctctgaggaatcgggccagttggttcgctttctggttcaattgcgcataactcagcacttggtcttcaaacaccaccgcaatggcgtccggcgtccgacgcgcctgctcctcaattaaggtatggaggcaagcctgtcgcggaaaatcagattcggtctgattccattgccacagcaatttatctttttcctgcaccggcaagacatgaatccgacccattcttctctctggtgcgctttccagcgcggtgacaatttcctgtaacgctgtctgcaagtagtcacagagaagttcaggatcaagcccctgttcgacctgtgcattaataacaaaatcgttggtgaaatcatcaatattgacggaaaccggataatgggttctctccatactgccggaataactgactccattgacggaggaaggattcattgcctgaaaaggatctgccgaaggaatgttgcgcatttcactgtgacgataattcagcaatgaagtgaacagaggcgctgttcccgatgtctgtactgatttctgtgccagcgccaatgacgcctgttcatgcctgaccaactgcgtcagagtatcctgagcattccagagacactcaaaaacagcaagattatccagacgtacccggatcggcagcgtattgataaacggccccatgatgttttcagcgttttcacctgcaaacatgcgccccagtaagacagtaccgaagacgacatcgttgcatccggtcaggcaggcgatcactttcgcccaagccagatgaaaaactgcggcagcactgacaccgtgtgctttggcttgttggcgtatctggctgcacaaccgttcttgcagcggtcgccaagcttctaccaccaccgcgttgccccctaaatattcaccggcaccaaacggtgctggagtcggttcataatcccgtaacatagcgtcaaaaaatgctttttgctcttccgcgccagttgcgcagaaaagacctgcgttcacctgcctgaacgatatgggcgcaatcggagcagacggttctgaatgcagttgcgcttctatttcctgctgcatcttttctaccgtcgtgtgatccaccgtcatatgatggatcaaatgcagcaatacccattcgtcccgtttcgggtcatagcaataaagacaacgctgcaaaggtgctttagtgatatcaaaacgcagcatggcgggatcgcaatgctgtttcaagatgaccaacggatcatcgcaatccatcgtaggtttcagctcttccaccgtcaattcagcgtcccgccaaaccacctgcaccggctggctaagtccttcatgatggacgctgacccgaaacgcatcgtgacgggcaattgtgccgcgcagggcgtcaacataagcgtgcagcaagtctgcattacggaaacggacgacctgccaaagcacatagggatctcccgccaaattcgtcagatagtgatagatcatcccctgctgcaacgcccccaaaggataaatatcttggatattggcgagacctccggggatagcggtaatcagagcgtcgatttctttttggctgagttgcgcccaggcggacgcttccaccatagagcgttccgccatgtcagagcgggtttcctgtggatcggacacctgcaactgtgtcgccagttcggacaatacgggatactgatacagcgtgtagccatctacaaagagtccacgacgacgcagcgccagcaccattttcagggtcagcagcgaatggccgcccaggttaaaaaagtgtgagtttctgccgatgtttttaacgccgagcaactcactccacacctcaaccaaggtttgctccaacgcatttttcggcggttcaacgtcttgtgccgtgaattcatcaaaagtgaccaccgggaaggacttgcggtcaattttaccgctggcggataaaggaaaaccgctgacgatgacgatagcggccagcctcatgtaatcgggcaccgcatcgttgataagccgttgaatactctctttcacgctctccctggactggcgctgtaaggcgcgttccgcggcaataacaaatccaactagacgtttatcttccgcactctcgccctgcgccagcacaacggcatcacgtacggccggatgcttcatcagacgtgcttcaatttcacccagctcaatacggaagccacgtaacttgacctgaaagtcattacgtcccagatattcaatgtcgccgccgggtaaataccgagccagatcccccgttcggtacatcacgccatttaatgccggactaaagggatttttgatgaatttttccgctgtcagttcgggctgattcagatagccgcgcgccacgcccaccccggcgatgtgaagctcacccgccacaccgaccgggcacggctggccgtaagcgtcgaggatataaagctgaatgttatcaatcggcttacctatcgggatcacattttccgggatcaagccatccgtttcatcaaggcagcaattccaggcggtgacgtcaatggccgcttcggtcggcccgtacaggttatgtaattcaaccttggcaaaacgctcccgaaaccgatgcacactgcgcgccggcagtgcttcaccgctgcaaaacacgcgttgcaggcaatcgcccacttctggcggcacctgatccaaaaaggcggataacattgacggtacaaaatgcagggtagttatccggtgcgcttggattaaagcgctcagataagccggatctttatgtccttcgggttttgccaccaccagacgggcgccgtacatcaggggccagaaaaactcccagacggacacatcgaaactgaagggtgttttttgcagaacgacatcattcgcattcaaccgatacaccttttgcatccataccaaacgattgacgacgccaacgtgctggttcatcacgccctttggccgcccggttgagccagaagtatagataacatacgccagatgggaagaagtcagcccgttatctgccggatgcaaatcatcactgttttgcccggaccactgcgagacatcggcctccaaatcgatcacgctgacatttgtgctcatcgcgtattgatccagcagcgcgcgaacgacagccggcaccgcaccgtgagacaacaaagcacggggagcagagtcatgcagcatgtagtcgagcctttcagcaggatagtgagggtcaagaggtacgtaggctcctccggctttcagtaccgccagcagcgcaaccaccatttccatgctgcgctctacgcacacgcctaccaaagtatccgggccaacgtgcaaatcgtctctgaggaatcgggccagcctgttcgccctacggtttaattctgcataagagagtgactgctccccgaatcgaacggcaaccgcatccggtgttttttctacctgccgctcaaacagttcatgaatgcaacaattcaggatagtgtcctctggcgcccggctctgattggaatgatcagaatgattttctgacagcaactgattaagcataactctcttcctttaactcaatgagctgaccgtttttcattgtgatcaggacatctgcttccgaaaaatattcgtcatcatgggtcacgacaaacacgatacgattctgggctttcaacataggaagccattccttgtaaaatcgggccttagaacgagggtcctgatccgccgcccattcgtccagaacgaccagagggctgggatcggccaacagcatggccaacgaaagacgcttgcgctgacctgttgataatttgatgttgtcaaaggcaccatcactcagaagcgtggctttttgcgtcaatcccaacaacgcgatgttctggttgacagcctcccgcaacggcaataacgcagggtcataaacccgtttgaataaccagttatcgctgaagattgcccgcgtgtgttccaatagttgatactgggaagcctcttcaccatttatccttatcgtgccttgggcggggacatacaagcctgctagaatcatagccagcgtacttttacccgagccattgccaccggtcaggaaatagcttttcccactttccgctttcaatgaaattggccctacaccgaagcattctcctcccgtggccggatagtgaaaatgcaccgcagacagttcaagcgtcttcacgtcctgaattcccggcattgtcccggcaggagagtcggtctgaatcgactgactgaacatcaccatactgttcatcaggcttttcagcctgatgagttcaggcatggccgacatcaccgcgttaagcggcccgatgaggtacagcagaatgatcagatattctttcgacacattaccgtcaaaatgggggatcaggagcggaaacatcaacgccaccgcaaccagtaaaatggtgagcaatgactcgccgataaagaatgcatttaaaaagccgagatcgtactgaatcctcaacgctttaaaacgatccgacacagcctgcgcatgacgatagaagctgtgttttaccgcttcacgccgtagtcctttatagcctttctgcaaatcttccacggtatccataaactcgctacggatgcttaatgcttgaggcataatgcgagtggctcgttcagaaatgcagtaatagagcacgatcatgggcaaagcgcaggccaacaggacagaagtggctacaggcgacttgaacaccatcaagtaggtgaataaaaagataatcgtcaacaaattggcgaagaaaggcacgaaagccagaacgcttttcgctaattcttgcgaattttccccaacgacggactgtatttttcccgaagatagctgttcgatgtttttgtaatccgacgccagcagcttcctgataatctccatccgccagccctgcacaaaagaatgcccaaagcgcatgatctgttgttcagctgctttacgggtggaaatgtagaagtagatacagctaaacagcagcacagcgctgtacagcaaatacgtagatgggctatcgatagcctgaatgatgaataaaaccaatgcggaattgagcagtccggaaatgaccgtcagaccgacgattttagcaatcatcaacgaggaaaaagtcttactggtatatctgtcgctgcgctgggtcaccagaaaaaagaacagactgatagcgttgacgaagaacaacaaccctacgacagcaacgggcaggcttaacggcccccaaaccagcagatttgcccagcttaaacccgacaatagcagcggtgtaatcgccagcacggacacaagaacgacattctgcacgagaagccgactgagaaaagagcgccagaccggttttcccgcagtgctttctgcggttcgaacaaaactctcttgtattatcgccgtctccactcggctctctagaacacttgctccatcgggaaccgactcatctcgatcgcctttatccttgttcccccttttatacatgaccgccactaaaagcagcgccccaccgagccagaaaatcacagccactaccgtggagagccagtcctgatcatcagtggggaaattttccggcaaacctgccggagaagcaccacgcaggtgttcgaatatcgcctgccccaattgaatcacctgagggctgttgctgttacctaacagggaaacacccacaccagccttcgggtcaaacgcgacataagctgtggcattgggattctgacccggatggctccagcttgtggttacgtcggttttcacatcccaaccataagcgtaccccacgtcgccattgccaccgtaagggcgctttgcctgctccaacgccgcgtataacgcagaccgcttttcatcgccattacccttgtcgctagccaagggttgctgatgcagtaagaacttcaaccaaatagccatatcctgcggagtactgagcacataacctgcaggtgtattttgcagataacggggcgcatcatacggccgggcgtgggtaaagctgatcttataccccggaatgcgcgcagatacagcagtactcccctctgccggcaaatcgccctccaccgttgtatttttcattcccaaaggcagaaagattttttcccgcatcagggttgcaaacgattttcccgtcgcacgttcagccgccaaacccaacaggctgtaattcagcgtggcatactcctctttggcaccgacgggataaaccagcgggatctccttcagcaataccggcaattttactaaagcatcagacgcatcataaggtcgcagcaagtcgatcgtgtcgcctgaaataccgctggtatggaacaacaggtttttaagtagcacggcggagtagcccatttccggacgctccgccagctcgggtatccattgcgtaatcgcatcctgccgattgagtacaccttcctgctccagcagcgcaatcagcaacccagtaaaggctttagaggtggaagcgagttcgaatgtacctgcctcctccttgcccagtcgccatgtacgaactttatcgccgacgatgacactcagtccgccagtgggaacttgcgcaacatcccaacgacgactcagctcaccgactatctgctccagatcaggatcttgcttctggctgataacctgtttctgatcgatcgtgtcagcgaacacgctgcccaccagcgcgagatagatagcgactaaaaaaatgcctatccggatcaatccagagttactcattgtcttcactcccctgaccgggcatatcctcaccggacacaacgccgcgtaatttgcgacgagcctgcaacgtgcgccgtttatctcccagcccttgttgcggcatctgcggttcttctgcaacggattgctccggtgccagctctttgctcaattcccgcaaagaggcggccttaaacagcagcgctaccggtatatcccgctccagccgttgctccagtcttttggcgaattgaataagatccagcgaagttgcccccaaggagaagaaactggcgcccacgtccagaccgtcaacaccgagaaatccttccagaatagtgcgcatagcctgcaataaatcgtccgcatttgcgcccttaagcgatccgtctgcgtctccatcgacgacggctggcgcattccgcgttgagccagaactgaataacatctgctgagtatgccgttgcttttctaaaactgagccgatgggaagtttagaaacagcgacataaggcaatttggtttgaccgacaagcgccgccatcgccacggctatctgcgttccttctaaattggataatccctctgctttcagcttttctacgaagctaagtgctttgccgcgttcttccatcgcgatgacaatcttgccgatatgtcgcccctgagccatgaactgaaatgcctcagtgatctctttggcgggataaacttttgtcggcaaaggcttaagtacctcgtcctccaacagtgcggcaacctcagcccaagcctcctgataagcgggatgttcggcacccgcctgcacggcgtggaagctgccgccttccgcaaaaatagacagtcccagttgccagttttgcaggatatcccgtaagccaagctccagaaatcggccttgcggcgccaataaagagagactttcttccagcaattctcctgccagcgcattgaggatcacatcaaaaggccgatctcccagctcacggcggaaaatatcaccgaactctcgcgttctggaatttgctgcgccttgtgcacccatttctctgagcaatcggcgtttttcttcgctgcccactgtcacccaaacttccgcgcctaaatacagggcaatctgcatcgccgccatgccgacaccccccgccgcggaatggatcaggatacgttcaccctttttcagattggcagcgtgcttcaaggcaatccaagcggtggtgaaagctaccggaacccccgcggcctgttgaaagccaagtgtccgtggaataggtgcgacaacgcgctgcggcataataacgtgttcagccaggcagctatgtcccgcacacatcacgcgatcaccaacgcgaataccgttaacctgccgcccaacgcgggtgacaatacctgccgcctcctggccaaaagtcatggtcgggtcggcaggggccggcaatacgccgagcgcaatcaacacgtccttaaaattcagtcccgccgccttaacctgaatttccacatccagcgggccaggctctttgcgtgtttcagattgtgagctaaaagaaaaatcgacgcttcctgcgtctctggcattcaagcgcatgacggtgtgttgcaaagcagcggatgcatcaaccagcaacaaatcactgattgccactaacagattgtcttcctcagaataaatattcacctgcaataacttgttggcacccagatcctgaatttggacgtggcttttcactctgtcgcacatgggcgcgaattgagtgaaagcccctattgagatgggggcaaactgtccatcttcatgctccggagaggcaatgagggtcgccgtgtccaacaacgcgacgtgaagaccggaggcttctgcttcaccccgataggtaatgggaagctgtaacagattcaacacttcattgattccggtctgatcaaccgcgatcacattttgccagcggggaccgaatgtcagcgcccctttcgggctgacgccgatgttatctttggcgctaaacaggttcaggagcggcggctgggaaggaagggtttttaaggaaacggtttcgccagaaagtgcagtatgaccgtcacggtatttaattttaccgctggcatgtttaagccaggtttcaggggaaaacttgccattgccggaaaataactcaaaggcgttcaagtcgtccgcaaagatcactgcgacatcaagctccgcgtcgttagccaccaccaacggcctctcaatggcgatctcctgtaatgagaatgcctctgccgccaccgcttgccactcaatcaacgcgcgatgtaccagaactaccattcccatggcgggcatcacagcagtcgctgcatcgatacggtgctcgtcaagccaccagtcgtccttggcgcacagccgacgtagccaaattggggcgtcgggcgccgtgtcctgtgccggatttttaagcgcacgatccaattgttgcgcggagcgggtcgccatgcctgattcagcccaatcatcccaggcaatagccagcgctttgccgcctttgtggcggatctgatctgcgtaggcttccagacaggcgttagcggcaacataagcgatttgaccgatcttttccttgggcagcaaattgcccagactggagaacagcaacagcgccggattgccaagtctactcaggttatcgctgaggaagcgggttcccgccaccttgggcgccagcgttgcaatcgattccgcctcagaacgcatctgcaacatcgcgccctctccgcgcccggcggtatggaacacgtaatcgatcccctctccccgcgcagccaattggaatacgggggcaaaagcttgcgccagagattcgtcatcgcccaaatccgcctgcaataactctacccggcttcccttggcttcaaggttcagcacccagcgcagaaatttcgcgtgggaaccgttgctttcaatctccatcggccaaccccgctttttcggcagggatttccgcaccaacaataagagattacaatgataaacctgcgctaaatgttcggcgatagccgcgcccatgccgccattggcgccagtaacaagcacccaactatctcggctgatgtccggcagtgggtgcgtcaaagcttgtttttgcacttgcgacgttacccgccgttgccaaaaatcgttctggcggaaacaatagaattgaccgccatgccagtcctgatttatccaaggttgtaatccacgggcaacgttctctacctccgaattttccagatccacgcagagggcagtaatgttggggtattcttccggcaggatcagcagcggccccagaagctggtttttttctgcattcagcgtctccgaacccttccatgccgccatttcagtcgaaggaaagaacagtcgtattttcggtgaaaaatgctgagttgtgctccatctcgccagaacagtcggcagccagaacgcccagaactccgcctgccgtgcatccagatcatccagcaatccggtaacaataatatccatcgcggcggacactgccagcccttgctgcaacagccagccttccagctcagcataaaggttggcgtcgctgccccgccagttcgcactctcaataaacgtcagttgacggttattcagttccagcgcctcagccagacgacgttctctttcctgaacctgtgggcaaattatccaagttgtcggcgtgtcccctgattgggcggcgttctccggcgtggatgagttgattttttcccactccagcccgtaataatgcgaaccgaaaaacagagatgaaattgtctgagccgcttttgtactcgcttgtggcagacaaacccgacgttcaaaagcgtgaccgggcaggtgcgttttcgttatggtacgttcgatggatgtctgcggatgaattctgctccaatcaatgccaccgccctgtatccagaccttggcaatgaattgcaacgttgaatttatctcgtgatccgcgccgcccgtgcctaaagtcggaacccatctctccccattcagatgcagccatttacgcgtgtgctgcaacaaatccatgccaacccctatttgcgcgaagagtgactcgggatgctcctgagccacctgctttaaagcagcacccaattgcacaggggacagcatttgattgatccaatattgcgggtcgcacatctcatccgcctcaattttccgccccaaagcggttgaatagatagcacactgcgcgggttgcagatcataacttttcagcaggtcaccaaacgctttcgccgctggctcaatcatcggtgtatggaaggcgtgagaaaccgccacccgcttgaaagcaaagccgtgctgcgtcagccagttctctgcgtctgcgaccaatccctcctctgtcgccagtgtccacgttcccgggctgagttctgatatgcacccaagcatcgccggaaaatcaccgtcaaagttttccttgctatttttgctcttgcgactggcagcaaagaccgcgccttttggcatggaatccatcagccctgcccgtgcaaccaccagctccattccttcttcgatgctgaacacaccggcgatagctgccgcagcgaattctcccagactaaaccctaacaaggccgtaggtttacagcctagtttctgtagccaaacacccaacgctgcctgaaccgcatataaaatgggctggagataaagggttgacagttgttcaggtcgcctaatactgtcaattaatgtctgttgatcaatcaatgccgctttttgaacggataacagtgccgcggctttatccagcagccccagataaatgtcaccgaactccggatattcagccgccaaacgcaggcccatttccggcgattgcgaaccttgccccggaaacaaccagactaactctgccatcggtgcataagcgccctccatcagcgtccagttatcaagctgctgttgccagtcatcgcgatggttggcaataaaagcggcgcgacaaggatattcggttcggttttcctgtagctgccgggcgatcacttcaaggtttgatgtttcttcttcggctaatccctgattaatcaggctgaggtggatggaataagacgctgctaatcgtgccagcgcactgggagatttggctgagagcggcagtatttgcgcggatttccggtgagaagcgtctttacctacggtttccggcggctgttcaagcaaaacgtgaacattggttccaccgataccgaatgagctgacgccagcgcgtcgaatcgcctgctttgccggccagtcggtggcttgggtaggcacccagaagggcgtcttgtccagatccagatgtggattgggtttattgaaatgtaacgaaggcggaatcttaccaaaacggacgctcaaagcggcttttatcagtccggcaataccggcggcggcatccagatgccccatgttggatttgacactccccacggcacagctgaattgctggagttcatccggcgagagcagttcccgcgcaacattattcaacgcctgaatttctatcggatcgccaaggacggtagcggtgccgtgtgcttcgatcatgcccagactcgaaaacggaatatccgccagccgatagacctgtgagataacttccgcctgtccctgcacactgggagcctcaaagctcacttttctatcgccgtcattgttcatgccggattcgatgataacagcatgaatggggtcaccgtccgcgagcgcgtcttccagcaattttaacaacacgactgccacgccgttgccgttcaccgtccctttcccgtcatcagagaacgttttgcagtggccgtccggcgacaggatcatcccatcctgatgtaaataaccgcctgccaccggatcagtgatacatgcgccacccgccagcgccatttcgcactcacccgctaaaagcgccttgcaagccagatggacagcggataatgacgtcgaacaggcggattgtacgtgcaccgccgggccattcaatttcatacgataagcgatttgcgctgcgaacgaagccggatcgttatagttgccaacatcgaacatttctgaaatatcctgactggctcccgcaaattgctccagtcgtgccagattcagcgtggaaccaataaacacccctgcctttaatatcgcctcaccaacgggtaaacccgcgtcgagaaaggcgttgaaactgacttcgtgcaacacccgcagttgcgggtccattttccgcgcttcccgctgtgagtagccgaaaaattcataatcaaaacactcagcatcctcaagcgaggctttagccggaacgtagttgggaagatcgatgatctcagacggcacgccgacagctaagagttcttcccgagagaaaaatgacaccagctcgcgtccggccagtagattgttccagaaattccgccaatcggaactttggggaaatctgcaagaaatgccaataatagcgacttcactacccgtatattcacgcttcatgatactgaacttcctttcactttacgccgcctgtccgccagtctgtttttacctgagcgagccgacgacagagtattttcttgggatagttgcttaccagaatcagatagcatcacttcggcttccgtattttcaggagatacgttgctctgtttgatccaatttgcaaaggcggtgatggttgggtgttcgaataagacggcgacgccgattttctggttgaacgcctgctgcatttgggattgcagcgcgattatttttattgagtcaccacctgcatcgaagaaattcacgtttgcatcagccaccgggttttccagaaccgcgctccagatagcctgtattttcgcttctacagaatcggtcaacggcacatgatccgtggcagtttgcgtttgccgtcgctgagtctcgcactccagcagtcgctgacgatcgatcttaccggtgatggtgcgtttaaaaccgtctaccaccacaataagggcagggagccacgacgctggaaaatgctgacggatatgttcccgcacacggggctccagaatggcaggctgttcgcggccatcgacgaaaagacaccattgccgctttccttcccgccccgtcgcggataacagacaacaagccttaacttcctccaatgcctcaacagcacgttccagttcacgcggttcaatgcgaacaccgttcactttcacttgatcgtcaattcgtcccagatacttaaaacctgacccatgagaaaaagtgaccgcgtcacctgtgcgataaaaagcctgctcactgtatttgacaaagtatttatcggactcaaccggattggtggcgtaaccgtgagccaccgcctgccctccaatccaaagctcgccccgtatatccgcaggcagtggcttaccgaagacgtccgcgcagcaggcgatgacattttgaattggccagccgatggaaacttccgcagcgagagattgtctggcagtcaggcagtccaccgtcgtctcactggggccataatgattgctgacggcgtagccctgctgcagcaaatcatccctgagccattgaggtaattcttccccaccgaagatccacaatcgcatagcagggaagaagggagcaccttgaatgagctgggcaatggcacccggaataaagttaatcagcgtgatggactcatcccgcagcaaatcgataaacgcctgccgctccaacaatacattgggcgatggatagatcagcgtagctccggcaacaaggctgccaaacagatcttcgacgctgggatcaaaattcagatcggtcagcccaagtacccgatccgcaggcgtcaggtgagtttcccggacaaaccaatccagcaggttcgccactgattcattacggatagagatgcctttaggcgctccggtcgttcctgacgtgaaaatgaagtaaaactcatcttcaggctgccgattgcgccataacgtcggttcgccagtggactccagccatgttgtctctgtttcgatattcagcagcaagtaacgcccgatgtcagtatcaagttccccgttcaaggaagcatcacataagacaatgccgcaattcgccaacgccaacagattttttttgcgttgcggtggatctttcgggtttacatagaagtaactgccgccactgaacaatatcgccagtatcgcttgggtggataacagtcccttttcgagatggactgccactctatcgccgggaacgaatcccgatccccgtaaccgttcctgcaagacagaaacgccccgtagcagctcgcgattactgatctgatgccggtcttcgatcaggcttattgcttggggtgactgattaaggcgctgataaatgcgcagcagcaaagcattgatatccggcgtttgcgcattgtgttctcccatgaccaaagcggcttcttcagcgccgtctgggttgagttttaacaccagatcttcaacccgtacatccgcagaccctttaaccaaatctgccaccaaagattcgaacgcgtaaaacaccctattcaccgcatcaggatcaccctcaaaagtttcccccgcgctcaactcaactttccattgatccacaccggaaaccgtcagagtcaaaccaaagtgcgtcgtctcttcactgtgcaggtccgtcagaaacgcaccacaaccggcgtcctgtaactcggcatcgatcgggtagttatcgaaaacgacaatagagtcatagagttcgtcacgtatcttcgtctcttctcttatcaacagcgggggcgttttttcatgttgatgagtctgttgcagcgcttgaaaaacggtgcgtaatgccacctccagacgccattttccgtcgagcgtcaggatcagcggcaccgtattcgtaaacagtcccaaaggttggcggtcgacgttttgtgtcaacgccgctcccctgccggaaaatgtacaaccgaaagtgacggttttttgaaaggtcaacttggccagcaccagcgcccagcacagatagacaaaacttgccggggtgacacctgcacggcggcaaatcaactctatcgccgctttacgttctttatcccatatgcagttcgcggtgattttttcatctgttattttttctcccgccttatgcttaatcgcggtatgttcggcagaacggaacagcggttcggccagcagttttgtcgtcgccgaagtttctccgtctggcaggtattggaaaacacgctgccagtattcacgactgagcctcagttcttcttggcttagccctttccagagttgctgcgaataaagccgtgcagccagaggaacgattttttgctgacgcaatccctgtagccagagagaaatcagcagcgagctactccaaccatccatcagaatatggtgaaaagagaaagcgactcttaagatccccgcgttaatatcgtggaaacaaatgatccgaaacacctccgtatccaactcaaacggcgtcgctttcgattgtgccagccaatcgagcgacggttgcggggtagttgagtcaacgtggatatattcaagcggtatccgtggtaatgcgtatatcgcctgatggggaacacgaatgccttcccaggtaaaaaccgccctcagagcgggttgtgactgctgtatctgataccagatatcaagaatcacttcttcactgacgtccgctttcagactaaatgccacgccaatatgataggcactgttgccatctttcaacgcgtgaaacagcaggccgttcgcttgcggcgtcacctgtagtaattcttcaatataattgggtttgtcggaataatagggctgcatcatattcaacgccccactgcattaaaaaggctttgcaatttcatcttttctaccagtaaagaggtatcccctttttcttcgataattttcagccattgctgtgtgtgctgatggaggaagccgcattcctcacgggtcagatgtgagccttttatcttttgtgttactgcatccctgatttgacgcagttgtacgatcgctgtcgcatcatttatgtcaggcaatctggaactataaagatggaaatgacagtaactgaaaaaccgttccagccggctctctgcagtacttaatgcctcagtgaaagtgaaaatttcagcgggttcgcacaagggcagcatgggcaatccggcgcgctgattcaggtaactcaatacggttttcggggaaatctccaaataacgggtgacgccgttttgcgcggcatactgcaaactccgcagccactgcacgggagaagtcagatgctgtaaaattgatggcttgagatcctcagccggtaactccgcgccactgacgttgcagaccagtctggagatcagcgtcccctgcttgtctgtgccaggcaggaagtcaagccattccgccagtttctctttggcttccatcattaaaggcgaatgaaacgggccgccgattttcaatggataaagcaacccgcccagcgcttccatacgcggcgcaaagcgtcgaatgtcagccatgacgccagaaaccgtcacctgatcaaacgcatcaatggcagatacgtacaattctatgccatcgtcttttctggctttatccacttcctgcaccacaacgtcggcaggaaggtgcaacacccaacacatgtcgccctgctcgtaatgacgggagcaggtttccaccacttccgagcggaggttcaccactttggtcagcgtcgccaaatcaaggtaacccgcagagcacagagccggatactgccccagactgtgtcccatcataaactcaggaacaagcccacagtacttacgtaatatgcccgcgatggcgaccgtagtcgccgtgagcgccagttgggcaatgcgcacttgttttaaagtgtcgcgccgctcgccatggatagcaccgtataaatcaacctgagacagatccgatacttcttccaaacaggctcggtattcgggataggctctgaattcggcaaacatatcgggttgctgtgcgcccacaccggggaataaaaataccgtcttcgctgagtcgatagcagttctcatgctgaggctccattaataatgagatcgagctccgattgtgagagctgacaaagggggaaatccgccgggatcaacataggttccacttgcgcgcgatgtaacgcatcgttccagactgatagtctttcgtttaattgcatcaggtagcgtttggcatcatcggcgccagctccgggaatgcccaacctcaactcaacgaaaacagaactggattcgcgatcgtcgtgaataagcacatcaaaatcagccacactcttttcgtcgggataccggaaaccacccgacagggaatcaaccagattaaaatggcgccatgttccgcgttcgctcagcccgaagccaatatcgttgatgcagataaccggccgtgtccgcacgccattcaatcccagttgttctttccagtctgagctatttgcatactggcgtgatttcaatgtccgtaaaaagaaaccgggtaaaaaaccactttgatggtctaggggaacgtggagattctgttgattgaagccagtaaaccaaccgacggaatctgccatcgctgcatgccagacagcaggtgtttctgcttcggagaataaacgcccgtggttttcaaacagcaccgcaagctgctccggtaacatgccgttatcctgcactatctccagcaaagcagcggcgatcaactgcgtgcgttcagctttgtagcgttgttccataagccggaaaccctcgctagaaactgacagcgccagcgtgacgggaacggctgccggctgataaaaagcatcgtcatggggtgcagattcagcatgagaaacgtgatcccgcagccatttcccccaaaggaatgcaccctgctcaacagcagcactggctttatcaacattagctttatcaacgttaagctgagccgccgattcgttcagcacctgatccaattcatccagtaagaaaatccatgaatggacatcgcagataaggtgatgacaaacccagatcagatattttttgttcgcaaccggagccaataccacttcatgcacactgggctggttttccagacaaacttctccctgcaatctgtgcagtctgtcctcaaggctttcgtctggcgccaatacgtgatcttgcaacaacatatcgccgttatgttgttccggttccaaggacgaaaaataaaactcactcaaactccggttcgatctcaacatgaagattttatgtcttgcttttaccgctgcaactgcgctgtttatacgcccggcgcaaatggagggcggtaactcaagtaccacgccctgttgcagtcgttcaccgtatttaaagtgatgttcccgaaaccagcgaacactgggtaaatagttcacccagtttgcttctggttcttccgatacggccgggtcggtcacagcaacttccggtttttccgcgcagactctttcaagcacggttcctaaggcggttgaagttaacagttcacttacaccgattcgaataccttgtctggcgagcaaggcgacaaggcggatcgctttgatcgagtcacccccctgtgccaaaaatgaggcggacagatccacggtttccggccaaatcggccttaaaaattcggcatccagccatgccgggagtgagtaggcttccggctctgtctgaccttgcctgtcggttgcacgaaactgagcaggatcggctgccgccagcgttgctttagcagcagcggtgagcgccgccatatcgaccttgccattggcattcatcggccaaggctgcacggtacagtaaagactcggcagccaaccgtcagggattttgtttttcaggtttttctggaatgcagagttgtcgtatggcacagattggctgctgcataaagcgaccgtttcatatccatcaatggccagttttaacgctttcaactcccgacggtcatcgccgtcgcgtccaagatccgccagtacttctgccacggctttctcaatttccgcaggatgaatccgatgaccacgcactttgaattcatcgtcaatgcgcccaaggcaataaaatattccctgttcatcctgcaagcccagatcgccagtgcgataccaacgatgtcgcccatcggcgccacacacaaactttgcctccgtctgcgcgcggttgttgatatatccatccgccagcactgaaccgccgatccctatttctcctttaaatccacggggcatattttgcccccaagcatctcttatcgacatctccgcttgccccagtgctttaccgataggcgcaatcacggcactcgttttgtcgttctcatcagattcgctcatcaaactttcgttcatcaaataaatacagcaccctaccgtcgcctctgtcggtccatattcattgatcactctgctgcccgaaggaaagaagccaagcgctctgtttaccaaagcgacggacaagttttcgccaccaacaataaaggtcagcggattccgtctctgggcgctatgttcaatcaataatgagagatgggatggtgtacatttaactcccgtcaatgcctcatcggagagaagggtttgcagtagttctgggttatcgcgaatatcctgttcgtgggcttgtataaatccccccgacaaaaccgggatcagaatcgctgtctgcgtcaaatcgaacccaaaggaagtaaacaaaggtgcattaaacgacgcctcagaagcgtattcccctttggctgccagcgcatagttcgccagtgcaacaggggaaatgacaacgcctttgggttctccggttgaccctgatgtatacagaatataagcaggattgctgtctgtttgttgtgaccgggcttgttcgggatgtatgaattctgactggatttccggatgcaagcccgcgtcacataaatctttatccagcgaagcgcgtaacagaggcaaattcagcgccgccgcaaggttttgatcaactccggtataaatgcagagagacgcgcccgaattacggacgatagtcgataatctcgccaacggcgtggtaggacaaacaggaaccacggtcacattttcaataagacaggtcaaataggcgagcgtcatttcaggcgagcgccttcccagaatcaccaccggacggtgttcgaaacgtcgatcccgcctgtcacgcaattgcgtaccaaacttgcgaatccactgccatccttgacggtaggtcagatcaccagcttcctgtttgaacagccagttatcggcataacgctgaaaagcgtcacataaatgaatgccgatcggctctgcgaggcaatcagtccgtacgttgatttcttttgtttgccttgtcgtttcttgttgccccatcacttcagcggcagcttccagtgcataatcaatgacggtttgcaggaatgcatgacattggtcgaaagaccagattttgcgaaaatcggcttcaatcttgaagtcaccaccctcaaagcgatcgtggatgtgcacggtggcaaacaacgcctccacaacctgaatatggtcaatctccacttcagcacctgagacggttttctgaaacacgcctgtttgataggaaacgccgaaagccggcacaatctgtctccattcctgcgatgcgaaatccccccaacgggcgcccggagcatagcgtgagtgcacaatggctttttgcagactttttttgagggtgcggtagcaatccgcgacggtttcccctacctcacgaaataccgggatcaggacgggagccactgacatggctattgactgtttttcggcttcgctccaacggttcagcataggtgcctgcaataaagcgccattgccgtcttcaatcaccatttgtgtataggcaactgcggcgaaaaacagccgaaagactgaaccgccgcgattactgaatttgtgcagcatgtcgttttgcgcttcgctcaaagcgatccgtacacgcatcgcgtgcggcttcaatccacgataatcccctattgggtagcggcaggagattttggtggcacgggctgacgccgtgtcgccatacgcattctgttcaccaaaaaccgtccgccaatacgccgcatcccttaccatacgccgggaattctcgtaatcccgctctctctcggcgtgaatagagtacaaaggggaattcaccttccccgattcctgcgccaacgcatcggccagacgttctagtaatatcgccaacgccgcaccatccaccgcagcatgatgcgctttcacaaaccatcccgattgttcctgtcggaaacgcaccgcaaaaatccgtatcggcgtgagtgataagtcctcttccaccagcagttgacgctccacccaactttcaaaggcctgtctggggtctggatgcctgctgaagtccactcgctccacatcggcctgaggcgtgttgtgccgaattccccgccataatatttcccaatcaacaacttctggatgaaccgtttctaaaggatcgttgacgaatccgatatggcacacatcctgcttattcctgacagtttcggccgcccataccagttgatccagcgacacatttccactcaagcgcgccacaccgcccaaataaaatgagtaaccggacagatgaaacgcttccattttgaaaacggcctgttgtgaccgcgatagctcaaaagtcggtttactcatggataaggtttccaactccgtgatgatcggtgaaaaacagatcccgcatattttgggctatcgtttttctgtcaagttttcctgagccagacctcggcagatttcgggcttgccaataacgagtgggtaacatgtaagccggcacctgcacagcgagaaattggcgaatatcctgctcattaagcccccttttgcctgcaacaatcgccgcgaccagccactgttcctgatcttcatcctcaaccacgcaagcaacggcctcggtaatagaagggtaattgagcagatggtgctctatttctcccaactcaatccgcaatccgcgtaatttgacttgcgtatccttccgtccctgacagaaaaagccccgtcttttctcatgccaaccaagatcaccggtcaggtatagtcgctgctgaagttctggatggaagatgaataccttatccgtcagatcttttcggttgtagtagccctctgccaaacatatcccaccgatggcgatttcgccttctttcgaatccgcttttaacgtcagactgtcgggttccaagatatataactggcatccagtgagaggctgcccaatgggaatggcgtccgacacggtttccacgcagtcataaaagctgacatcaatggcagcttccgtggggccgtataaattggtcaacaggcagcgcgaagcaaatattttctgaaattgagtcaccagactggctggcaacgactctccactcacatacaccctgcgcagcgccgataacgatggcgtttcagcactatcatcctgaagctcttgtagttcttgcagtacgggcttcagcaaactgggaacgaagtggacaaccgtaatattttcgcttatcaatgcagcgactatacctctggggaatgcttccaatcccggttgcagcagataattactcgcgccattcagggcaggtaaaaagagttcccataaagacacatcaaacgtcaacgccgttctttgtaagataatgtccgcatccgtcatctcactatgagcctgatgccactgtaatcggttaatgaaggcgccatgattgaccagcactcccttgggggtgccagtcgtgccggaagtgaagattaagtaggccggatcggtagcccgtcgttgacgcgcttttttgcccgcgctttctgaatgatgaaaactcagccgatggtcatccagacaatgagaggtgaatatttctgtcagaaattcacgcccgatcagttccaatccgggtttggcctgagtaaacagactctcctgtgccacattgcaaaaagcgatacgacattgagccgtcgcaaacatagacgtcaaccgagcggcaggcgttttcgcctccacaggaaaataaacgccaccagcaagcagtaccgcatatgccgccaccagaaattccgggctgcgctcaaggccaatagcaacacaatcgccctgacatacaccgcgctcattaaccagataatgagccagtcgttgcgccctttcgtatagttctgcccaggataaaacgttcccttttccccaccgtatcgccggattctggttatttctcgccgtactttcgaaataatcagtaataaatcgaccagttgccatgatgccgacatcctctgagtgctggatttgttcaaatctcattgtgacctgacgttcatctgtaacgtcaggcgatagaaacccgtcagccggacgcaacacgtcaagcttttcagggggaataatgttgagacgatttatggaatagtctgcgcgacgttatggctgtaccgattgcatactgctttgccgatcagcattttttgaagttcattgctgccttcaacaacttgcaatattttcgcatccctatagagccgactgatgccgttgctttcatcgcaaccgtgaccaccgtgaatctgtaccgctttcgctgctgcggtgccagcttcatgcgatgagaaaagtttggcttgaaggatctgctcaagagcgtcttcatcccttgtttctttggcttttgtcgctgataagcaaatgagttgagaggccagcaggctactggacatttccgccagatagccgcgaatgataccttgatccgcaagcaacgtatcaaaggtggcgcgggagttagccctgcgagcggatgccgccaatgcggcctgctgtattccaagcgccgcccaggccacgctgatgcggccatagtccaaggcattgttagaaattaggttttgtccgaatccgggctttccgacgatattggtcttaggaacccgacaatcagtgaaatccaacaccgccaaatatgcgctcttgaagcccagcatattttttttggcggtcacttttagccccggagtatctttaggaaccagcactgcggtatccagtccctgatatttaccgaataccagaaataaatccgcaatctgggcgaaagtaatccaagccttttgcccattaacactgagataatccccgtcttcttcaaactgagttgacagatttttggaatctccgccagcggaaacttccgtttgcgcgaatgcaccaattatttcaccctttaccagcggtgccaaaaagcgttgtttttgatcttgagaaccccaatcttcaatggttttcaacaccatagaatgcacattcagcaaacccgtgagcgaaccgctccctgcgccgatggccatgttcagcaatccgaaagtcgtgacgtcaaaccccagaccaccactctcgggttttgccagtccccccagccaaccgttatgtgcaagtttttgcacaaccgttgcaggaatcgcttctgctaaatcccattcgtcagcataaggcgcgatttcagtcgctgaaaattgctcaaatgtctgtaaccactcgttttgcaaaggtgacaaaaaacgattaagcatttaccgccacctttctgtccaaaaagtggcagacagcctgaatactggaaaaattggcattatcaaggtcatcaatttcgactttgattttgaagtttttttcgagaaaggagattagctggatagcggccaaagagttaaccaagcctgtttcgaagatgttgaccgaatcgtctaaatcctgtttgccagcaagtttgcacaggtattcagacactaattttttacgcgcagatacgtccatcactaatttccttatgcgaacttaatttcgtggatctttctattgtaaaaacggctggaactattatagctaccgcatgagagtgtaacttcccgaagagaatacaaaatcagaacaggtcactgtaaccgacattagttgaatgcagattaatgactgtagaactctttttatataacataaaatattatttaaataaaaattattaacttacgatatattatcattcaagtgaacatatcattaagaaactatatatcttcaaagaaaaatattcttctcattttttgtgggggtataaatagaattgaattaggctgtagcacaggttacgtcggtatatcaagaaattaagacaatatattatcctgaagagtgaaagccgcataaaaacggtataatagctatttgctatgagccagaattaaacgtaataacgaaacatttaattctgccataatacatagaaaatttagaagaagacccttatgcaccttaaaatacatctcgattccgtagatatgccaatgccataataataccatggcttgacaataaattaacatggctccctacaaagaaaagcgataagggagaattatcaggttatgatcaagaaaataataaccctgaatataataatatccgttatttcaattcaattagttctgaactaaaaaacacaaaactactgcaagatacattaatagacgattttaataagacatttttttctgaaagaacctaatctacctatatacgcaggtgtccatatagtgagaattatctgttcagacaacagtaaactaggatttagttcccctgattgctttcatcaagatggagaaccttttacatttgcgcatttagtaaaaagaagtcctaatgctttaggaggtgataattatattgctaatgtagcatctaggaataaaaagttggaagaggtaaattcatctgatataatttcaaaattcaaactgcaaaattttctagaaagctttgcagtttgtgatgaaaaagtgagccattatgtttctcatttaactctagaagagaagactggcgaatcctataggtgcatgatattaattgacttttcttttaaaaaaacagagcatagaatgaaagattccttatcggtaatcgtaattatcgtctcattgctaataattggatttttccttggaaaaggaataaaaactaatactagagattatctagtaagtttaatatcaaaaatagttattatccttttattatgtatgggcattgaacttggagaggtttttaataatacaaatgctggtgtgtcaatagttaaaaaatctataattttggcttcattaatctctttatctactttttttctattcataaaatacagagaaaagaataaatctggttataataaaccaaacttcaagaagcctattattagctgtgcagttgccatgctttctttcattttaggtgtcttattttattcatatactaaaatatcactgcatagcataagcttatctagtaactatgtactctatttacttatagttcttgttggaatggatttagtaaactttaaacttagcggaataaaatttgacgcaataaaaataccatttataacaattttaggaactgttattgctgcagcaatattttctaaaatatataactactctttaatagagtccatgttagtatccagtggttttggctggttctctctttcagggccgatgataaatactctggcaacccctgagctaggagctctagctttcatgactgactttttcagagaaataataagtattacttttctttattttatgggaaggtcacaaccacaaggtggaataggtatttctggagctgctgctttagattccgctcttccatttatcaaagaaaactgtaaaccagataatataaaatatgcaatagttagtggttttatattaactttactagcacctttactaatctctttattagcaagcttattatagtaattactctaataacaaatagctaaatctaaaaagcctcgtttttaatagcgaggttttttcatgatatatcacaatataccaataaaatttctctattcagagagaaggaatcgataccattttgaattatatttaaggaatagaatgcttcaagaagaaattgtaactccaaagtcccaaaaaacacaaacgacacaaacgacacaaacgacacaaactttacgtcgtgagctaaaatcacgacatctcactatgatttgtttttcaaccatcagtaacggcttgtaatgggctaaaaacgcaattccactcacctggaggatttggtcaaatttggaagtccctaataaaaaggtcaggagtcaggcatagaaaagcataccaaacacgacatacatatgcttgctggatgctatctgctggcgctaatccgtcatttattgcaacacagatggggcatgtttcatcacaaatggttcataacgtttatggcgcatggatgaatgaaaatagtgatgaccaaattaagctgttaaataaaaagctcacgattgccccatgtatgtcccaagtaattaatgaaaattaattacttgatataaatcaattaattaacccatcacacctgcatactcatgatctcatgatatgcactgaccagcttattcctgacctgaatccccatctgcaatgaaatgctcgatttctgcatattaaccatcacgtcattcaattccacacccggcacacccaacgtaaaatcctgagacaacttagtcgccgacagacgggtttgatttattttttctactgcggcggtaaggtggctggcaaaacctccctgtactggcatgggtttggcaatgttcgttgcctgtaatgcctgtgccttcatctgttgcagtacaccttcaattgcctgaattgacataaaaacctcgcgttaaatcaccctattgattatgtgattaagtgccatattagccttgggctgacatggcaatttttccacgctgccaccgtaacatagccctttcaaactaaagcgcgtaattgaagtaaaaattcaaagcttattgtgccattaaaagaggtgtgaacagcgaataatgatgggattaatagtaggaagaatcttttcgcttgcgtatggggagtctgttttgttacgccacgcttttagtattcatgttgaccagcaaggcaaggatcgtctatgagtgcagcaacaaccgacgttgagaaccaaaataaaggtttcagcgctatcatcagcaagataaaaactgatccaaaagttccattattagttgctggctctgctgccatcgctatcgtagtcgcccttttcctctggatgcgcagccccgattaccgggtgctttacagcaatctgagtgataaagatggcggcgagatcgtcacgcaattaacccaaatgaatatcccttaccgttttgctgaaaacagctctgcgctcatgatacccaccgataaggtacatgaagcccggttgaaactggcacagcaagggctgcccaaagggggagcggtgggctatgagttattggataaagaaaaattcggcatcagccagttcagcgagcaggtaaattacaatcgcgcaaaggaaggtgagttaagccgtactattgagtcccttgaccccgtcgagagtgctcgtgtcattctgtccatacccaagccttctctattcgttcgtgaacaaaaatcccctacagcttccgtaacggtaagattactgcaaggccgtactctggatgagggacaagtcaacgccattgcgcaccttgtttcaagcggtgttgccggtttaccgccaagcaatgtcaagattgtggatcagtcggggcgcctgctgactcaagccgatgccaacgggcttgatttaaacaccactcagttgaaatacatccaggaagtcgaaaaacgtttccagaatcgtattgaaaccattctgacgccggtggtcggccgtggcaatgttcatgctcaggtcacagcccagcttgatttctctcgccgcgaacaaacggcagaagagtataaacctaatcagccacctaatgaggccgctattctctctaaacagagcagttccagcgaacaaagtgggggatcactggttggtggcgttccgggtgccttatcgaatcaaccgagtgcagcaccaagcgcaccgattgagaaaccaaatccagacacgaaaggcaaaggtgacgaaaaatccgaccagaatcgcaatagcacctataacaattatgagcgtctggtgaacaacagccgcaataaccgtcatgacgaactgattaactatcaagtcggtaaaaccattagccatacccaattacaggtaggcgcagtagaacgtctttccgttgccgttgtgatcaactatgccactgctcagggagaaaatggccctgaaacaaaagcactgacaccagaacagttatcccagatcgaagcactgactcgtgaagcaatgggcttctcaactaaacgtggcgatagcctgaatgtcgtcaacacaccgttcaacgatacggctgaagtgatagaactcctgccgttctggcaacaccctgtcctgctggaaaaaacgttagagttgggccgttggttactgttggcactggttgcatggctattgtggcgcaaaatgatcgtgcctcaaatcgccaagaaacgtgcggcggaaaaagcagcacttaacgcgcagaaaaatcaacagaaacagcaagcgccagaatccaacgcagaactggatgaaaaagtgcgccgtaagctggctcgccaacgagtcaatgccgagattcaaagccagcgtatccgtgaacttgcagaaaaagatcctcgcgttgtcgcgctggtgatccgccaatggatgagtaacgaacaatgagcctgaccggaacagaaagaagtgccgtcatgttaatgaccctgggagaagatcaggcggccgaggtgttcaagcacctgaattccagggaagtacagcaactgagtatcgcgatggcggggatgaggcaagtctccaaccagcaactggctgaagtgctggcagagtttgaagaagatgcaggacagtacgcggccctcagcatcaacgccaacgactacctgcgcagcgtcttggtgaaagcgttgggcgaagagcgtgcttccagcctacttgaagacatccttgaatcccgcgataccacaacgggcatcgagaccctcaactttatggagccacaaatggcggctgatatgatccgcgatgaacatccgcagatcattgccaccattctggttcacctgaaccggggtcaggccgccgatatccttgccctgtttgatgatcgcctgcgcaatgatgtcatgctgcgtattgcgacctttggtggcgtacagccgtccgcgctggctgaattgaccgaagtgctgaataacctgctggatggccagaaccttaaacgcagcaaaatgggcggtgtccgtactgcggctgaaatcatcaacttgatgaaaaaccagcaggaagagagcgtcattgaggcagtgcgtacctatgatggtgaactggcgcagagaatcattgatgaaatgttcctgttcgaaaacctcatcggtgtggacgctcgtagtatccagcgcttgttgcaggaaattaccaccgactccctgcttgtcgcattgaaaggctgcgatcaggcattgcgcgatcacttcctcaacaatatgtcgcagcgtgctgctgaaatcatgcgtgatgacttggcgacccgcggcccggttcgcatgtctcaagtggaagccgaacagaaatccatcctgcttgtggttcgtcgtttagcagaaaacggcgaaatgatcctgaatggtggtgatgatacctatgtctgataagtcgaataaggcaatttggcagccgtggcagccaaatgaattgactcagtgggaaacactacgggcgaaactggagcccatggacaacgagccggagcctagcgagcaggatcgtctgctggtgcaggccagaatgctggacgcgctgaaagagcaagcgcgtcagaccggccatgaacaaggctttacggcaggccaggcgcaaggttatgaacaagggatacaagaaggccgacaggcgggtctggagcaagggttgcaggaagccagacaacaacagcagattgttgttgaacagtggaaagcgttgctggaagattttagccattcactggatgggctggatacggttatcgcttcacgcctgatgcagctttccctcacagcggctcaccatattctggggcagcccgcagtgtgtgatggcactgccctactgaaccaaatccgtgaatttatccagcaggagccgatgttcagcggaaaaccacaactgcgagtccacccacagaatatcccgctggttgaacagcaactgggggaagttctggcattgcatggctggcgtctgattgcagataacaagctgcatccgggcggctgtaaagccagtgcggatgaaggcgatctggacgccagtttggcaacgcgctggcacgaaatgtgtcgtctggcggcgtcaggagaattgtgatgactgcacgacttgggcgctggctggcaacgttagattcactggaaaaacgtctggaaaaaaccccgaaagtccgccgttacgggcgtctgacccgcgcgaccggtttagtactggaagccactggcatacagatgcctttgggcgcgacctgtctgatcgaacggcagaatggcagcacgattgaagaagtcgaaagcgaagttgttggtttcaatggcgaaaaactgttattgatgccattggaagagctggaaggcatagtaccgggtgcccgcgtctatgcccgttcttacggcgaagattcggctggcggacgtcggttgccactggggcctgaattgcttggcagagtgctggatggctctggtcgccctctcgacggctttcctacccccgatacaggttatcgtgcgctgttgaccacgccccctatcaacccactgcaacggacacccatcagcgatgttctggacgttggtgtgcgggccatcaattccctgctgaccgttgggcgtgggcaacgcatggggctatttgccggatcaggcgtcggtaaaagtgtgctcctcggcatgatggctcgctatacccaagcagacgtgattgtcgttggactgattggtgagcgtggccgcgaagtcaaagatttcatcgaaaacattttaggtgtggaagggctggcacgttcagttgtcgtggccgcgcctgccgacgtttcgccactgctgcggatgcaaggtgcttcttatgccacccgcattgccgaagatttccgcgatcgcggcaaacatgtcctgctgatcatggattccctcacccgctacagcatggctcaacgcgaaatagccttggctatcggcgagccaccggcaaccaaaggctacccgccttccgtgtttgccaagttacctgcactggtagagcgagcgggcaatggcgtcagtgatggcggttcgattactgcgttttataccgttctgacggaaggtgatgatcagcaagatccgattgccgattccgcccgtgctattctggatggtcatatcgtgctatcgcgctcactggcagaatctggccactaccctgccattgacattgaagcttccatcagccgcgccatgaccgcactgattgataacgaccattatcgatgggtacagcagttcaaacagttgctttccagctaccagcgcaatcgggatttgattaatgtcggcgcttacgccgcgggcagcgatcctttactggacagagcgattcagctttaccctcatatggctcagttcctgcaacagggcatgaatgaacgtagtgaatacgatgcggcatgtattcagcttcaacaattattgccgatataacttattgccaatatagcttattgctaatacaactttgctattaatgtaattcagtaacgcttatgtctgttttgtcatttaaacgaggaaatacatgcaacagcactcccctctcgtgactttacgtgaacttgctcaagatgcggcggaaaaagcggcaagtcaacttgcacagatccggcagagtcaccagcaaatggagcaacagctcacggcgttgacggattatcaggatgaatatcgtacacgtttaaatgacacactcagttgcggcatgtccagctcaacctggcaaaactatcagcagttcatgaaaacgctggaaatggcgattgaacaacacaggttacagcttacccaatggaaaaatcggcttgagcaggccatgtcacaatggcaggaaaaacagcagcgtctgaacgccttcgacacactgcaacagcgggcagagcacaatttgaagttacaccagaatcgcatggagcaaaaacaaatggatgagtacgcacaacgtggtgcacaacggagaatgaaacaatgaacctcactcttttgcctactgatataaaactcacggaaaaaagtcagccgacgttgaatgatcccttggcccgtaacaattcttctgaatttgggcagcatctcgatgcagaaatagcctctgtgcggaagacggcggcccgggctgataaaaatggtctgaacaatgagaagcaccccagcgataacccaatcgaaggtgaattggcacccttactggctgtagcagacaacactgtaattaacgttggtggtaaaacgctggctgggggcaaaccattgacagaaatctccacaccggaaagcgatattgatttcgctgtgttgaaggatgaagatctcttgtctgctgaagctctggttgctgcaatgccaatccaactcgcaggattgatcaacgctcagtcgattcctgcggagggtgttgaaaacacagacgaactgctacgtggtgaaaataccggtgcggagactttactgggtcagaatgtaaaacctggcaagagtgcaaaagtcgatgctgcactgatcactacagatcgtactgaccacaccaaagatggcgaacaagataaaagtatccggtctttcgccacgcaagagactaccctgagcaacaacgcggaacaatcaaccaaaacacgtccaactctggctcccgttgccgggcaagtgaaactcgccatcaataataaagcagaacaaaactccgcttcccaaaataacggaaaagagttgaatcagttccagacagcgattcaggggatacccgcacgggtggcggccgcggctgaaacttcccagccagaatcacctgcgataccggctgcctctcccctgctttcagcgggacagcaaacaaccggtcaatttcagttaaacggcactcctgctccgctactgagtgcccatcttggcagtgaagagtggcaacagcagctcaaccaacatgtcctgttctttaatcgcaacgggctgcaacaggccgaattgcgcttacaccctcaagaattaggcgcactgcatatccgcatgaatgttgaagacaatcaggctcaactgcattttgtctctgcacaccagcatgtccgtacagcactggaagcggcgttacctgggcttcgccatgcattggcggaaaatggcatccaattagcacaaagcagtgtaggcggtgacactcagggaaactggcagcaggaacaggcgggcgattcaccgagtcattcccatcactctgccaaggctcatggacgggatccagccgccgtgacacagatgccaacgactcatgaatcagccatcaaaataacaccgcagcagctcgcttcaattcgcggaggtgttgatattttcgcctgatttcaggatgcacggtaataaacggcaagaaaaagaaagaaggccgataacaaacgtatgagttaatggttttttccgcgtttgttctcgctattggcggaacaaagacgcgggataattgatatcgattttgatggataagaagacccgccacggaatgcgcgggaacttatccgcaacggaaaacaggaatttgtctgtccatgtctgattatagctacgagcgtaaacgcacaaatccaatttggataatactgttaatactgattgctgttcttagtgccgccatcggagggtatagctggtggacaatgaagcagccaaccaagaacagcaccgaaaaagccaaagtcatcagtaccccggtatttatgacgctggagaattttaccgtcaatttgatcgacaacgaagaccatattgaccgtgttttacatgttggagtgacactgcgcctgcctgatgaaaaaacccgtcagcgcttccatgattatctgccagaagttcgtagccgtatgctgctattgttatcccgtcagaaagcgatagatctggcgaacgatgacggcaaaatgcgtttggtggcagatatcaagcagacactgcgcccaacgatgatacccggtgagccagatcaagtggtcaccgatgtgttgtttaccacgtttattttgcgataatcacgatgagtgacaatattctttcacaggcagagattgatgctctgctcaatggtgacagtgccactgccgatgacgtagaacccactgcgtcaggggagagtgagattcgaccttacgatcccaatacgcagcgtcgtgttgtacgcgaacgtttgcagtcactggaaatcatcaatgaacgttttgcccgtcaattcaggatggggctgtttaatatgctgcgccgcagcccggatattacggtcggcgcgattaaaatccagccttatcacgaattcgcccgcaacctggccgtgccaaccaacctcaatctggttcatctgaaacccttgaggggaaccgcattattcgcttttgaacccagtctggtttatatcgccgttgataacctgtttggcggtgatggccgttttccgaccaaagtcgaaggccgtgaattcacctataccgaacagagagtcatcaaccggatgctgaaactggcactggatgcctaccgtgacgcatgggattccatcttcaaaattgaagtggaatacgtccgttccgaaatgcaggtgaagttcaccaatatcaccacctcaccgaacgatatcgtggtcacgacgccgtttcaggtggaaattggtgcactgtgcggagaattcaacatttgtattcctttcgccatgattgaacctctgcgcgaacgtctgaccaatcctcctgtagaaaatgcacgtcaggaagacggccagtggcgtgaaagtctggtgaagcaggttcagcattcagaattggaactcgttgctaactttgttgatattcccctgcgactgtcaaaaattctccaactgaaacgcggcgatgttttaccgattgagagaccggaacgccttatcgctcacgttgatggtgtgcccgtgctcaccagccaatatggaacactgaacgggcagtatgccctgcgtgttgaacacctgattaaccctgttttaaatgctctggatgaggaaaagcccaatgagtgatgctaaacaacccgcagaagccagactgactgaagatatgtgggcagaagcactggaacaacaggccgcacagcaaacctctgacagcggcgcgtcaatatttgagaacctggagccgcaggacgcgctcgcccagctttctgatattgacctgatcatggatattcccgttaagctctctgttgagctgggacgcactaaaatgaccatcaaacaactcctgagactgtcccaaggctcagtggttcctcttgatggtcttgccggtgaaccactggatattctgatcaacggctatctgattgcacaaggggaagtggttgtcgtatccgataaatacggtatccgtatcacggatatcatcacgccttctgaacgcatgcgtcgtttgagtcgttgaccatgatggcgaaccagccttccctttatgcttcttttcaacatggtgcagcatctgatgctgcaccggttaacgcaaaagctaataccctatctgcgaacacggtgaaacccgcagccagtccagaacccctccccgccagtcagacactaatgcaggtcagcagtgcactaggtggcatcctggtgctgatttttgtcatgacatggctgattcgccgtctgggtcttgcccctgccaagaacaaaaatcaccggctgctcaatgtgaaagcgagttgctctcttgggccaaaagaacgggttgttgtgctggagatcgaagacagttggctcgtattaggcgttacaccccaacagattaatgtcttgcatcagatgcctgtgccacctgataacgcggaaaaggaaactgcactcaagacgttaccctttagtcaaatgttaaaaaatacgctccagcgaaaaagcaagaacgacaaggatgacgatgaaaaatagcgttttctttatgacaggcactccaatgactggcaagaaatttgtttctctactccggcctgtgcatttagcaaccctgctgatggcgcttttgttgccgctatttcccatgaatgccgcggccgcattgcctggcattatcagccagccgatggcaaatggtgggcaaagctggtcactgccggttcaaaccctagttttcatcacggcactgggttttatccctgccgctttgctgatgatgaccagctttacccgcatcatcatcgtgcttggtttactgcgtaacgcactgggaacaccttctgccccacccaatcaaatcatgattggcttggcactgttcatgacttttttcattatgtcgcccgtattcgataaggtttatcaagatgcttacttgcctttcagtgaagacaagataagtctggaagctgcactggacaaaggtgcccagcctctgcgtcagttcatgttgcgccagacacgacaaaccgatctggcactgtttgcccgtcttgcggatcaggatgcttttgaaacagcggattccgtccccatccgtgttctggttccggcatttattaccagtgaattgaaaaccgcattccagattggttttacgctcttcattcctttcctgatcatcgatctggtcgttgccagtgtcttgatggccttggggatgatgatggttccccctgccaccatatcgctgcccttcaaactcatgttgtttgttttggtggatggctggcaattgctgcttggttcactggcacaaagcttttatgtctagcgaacagtttttatgtctagcgcgaaatttgcgtgaaatcctattggaacaagatcgaaaaagcggtttaaaaaaattatgactccagaatcggtaatggctctcggcattgaggcaatgaaagtggcgctggcgctggccgccccgctgcttctgtctgccctgatatgtggtttggtgatcagcctgttgcaggcagcaactcagataaacgaaatgaccttatcgtttatccctaaaattctggctgtttttgtcactatcgttatcgctggcccgtggatgctgaacttactgctagattatatgcgcgtgctatttagcagtattccaaccattatcggctaatcatgatcccgtttgatagcgaaatgctctctcgtcttgtcagtgattttttctggccactggtacgccttttggcgctgttcagcacagcccccattttcagtgaaaagcagacaccgataaaagtcagaattagtttggcgctggcgatcaccttcttgttggttcctaacataccctctccgcaaattccgatattttccgttgcgggggtttgggtcatgatacagcaggtgttgattggtgttgccttgggattaaccatgcagattgcttttgcagcaatacgtcatgccggagaaatactcggcttacagatggggctttcattcgccacattttttgatcctactggtgggccgaatatgccgattttggcgcgtattctgaacttgctgatgatgttaatgtttctggctttagatgggcatttatggttactgagcattattgccgggacatttgattcgattcccattcaaccaatgcaattgaaccccaaagggtttctgttgttagcccaaagtgccagtttaatcttcatcaacggtatgatgctggcaatgccgttgattaccctgctgttggtcctgaactttgccttggggatgctcaaccgcatgacgccacaactttccgtgttcgtcatcggctttccgctgacgctcaccgtggggatctttacactttccctgttgttcccgatgctggcgccctttactgaacggttaatggcagaaatattcgatcggctggcagtgattatcggggagttggtgttataaatcaccgctccccggtacccttttatgtttaactaaaattgggctgaccatttgatgccgtaacaccaccatcgacgggtaggttaacgccattaataaagctggcatcttcgctggctaaaaatgcaatagctgatgcaacttcagccggtgttcccgctcttttcatcgggatgcgggaatcgaatttttgcagaacctcatcggacatatattcggtcattggagtgatgatcaggctaggacacactgcgttgacccgaatcccctgtgagccatgatccaatgccatagcacgggtcagattgaccaccgccccttttgcggtacagtaataagcattgccccaatcagcccttatccccgatacagaggcattattgacaatacatcctttgcttttgagcaaatgaggcaaggcaaaatggctgcaataaataacgccatcaaggttggtcgccaacacttttttgccatcatccagcgaagtatccaatatcgtactgggaatatacaacccggcattattgacgagaatatctatcctgccgaagtgttcgatggtctcatcaatcatcatcttgacggaatcctgatccgacacatccgcctgaatgacccgtgcgtggctggatgacagctcactgtacactcgattaagtttatcaacgttgcgtcccaccaaaacaacaatagcgccttcttgggaaaaacgctttgcggtggcttcaccgataccacttcccgcaccggtaatcacgactactttattttcaaatcgcatcattttattactctcattgacgtattttcaaagttcgccacaaacccagactgacggggacaagcagcataaatacctgcccacatgtcaccggatttgactgcgataaatggcgttattctgaccgtatttggcaggccatcaccatatcgcatggataataaacaggctcccgatgatatttcagcaatcagggtaatcggcatactgatgtcatcaatgatttcaccagaccaatccgataccccctgtgatgttactgtcgtgcctaatttaatggttttgtctggctccagttccagtgagaactttatccaatttttatcagacagacggatcattaacccagcctgatcataatcctgctgtggcgagaaaataatctccgttgaaatgacgacattaccgctaaaagaagccaacaaagcatgtccattgagccgtatgaccgaagtaggtttcccgccagaaatcggtttcagacgcaggttttattctgcataatccgatatctgtttcccaataaggagctgggttcaaccatttaaccgtgctgtttactggtaattcaataaaaacatcattcagcatgttgatgctctcactgtgtaatatcaaacacgatcagcgaattcagcccgtcttcaagggcaggaaacagaatgtcatcacacaatgccgtgtgagcgggtgatgccagatagtgttctagctgaaattgatcatcaaattccagacgaagaagatagcaatatccttgatcccgcccttccagactggaattcagatgccagcttgcatggcgtatttcaggtatggattgcggcatagacacgagtttatctaaaacggattttatgtcgtcgtccagcaagttatttttaaatttataggaaacaagatgttcaatcatcatatcctccagaattttatttgcagcgtctttttttatgtcacgttaatcactaaatggtagataagggatcaaccagcgttttcgttcccagtatcagcgaaaaatgtaataactctttttccagtgccttcaggccgatggtttttcctaacaaagtagaaaaaaacggctggtgtgcgacgacagtatccctcgattggcaaaaagtttcccgatcacaaccggccagagaggtgacaagattaatttcccttgtcatcaactcattaggactaaatgaaaacgtcgcttcagccagtggtaccccataaatcatcaatattccaccacgccggacagcatggaaacagtccgccagaccctgctgtgacccactgcattcaatggcaacatggaaatgttcctgcaggatttcagtgattcgttgaatagcggggtaagattcagcccaggccatggcatctgcctgaacatcatagagcgtcaattccagtgcggggtacaaagtatgaaggagataagtgattaatttccctgaaatccccgatccctgaaccaacactttgatttctgactgggtattgagaaccgtatccaaacgtttgatgccatgtatagcacaggccagcggttcaatcagcacgccaatgcggtgatcaatacaggtaaaaggcaccagattatttgctggcgcatgaattttactggcaaagccgccatgttcattcacgcccaattctcgcatgtggcgacaatggctggtttttccttcgagacaataatcacactcgccacaattgatctcattattcagcgcataatattgaccgtgcccatcacgacaaaccacttcatgcccaagaaccgtattagtacgcgctggattatgcgtcaaattaacatctgtccggcaaatacccacccgataaacctcccatgctggccattctgtattggaatcgggcatatcctcgatataacgaaactggtttcgctcaattaataccaatgcggccattatttattctccaatttcttatgcagattagcgataacttgatccagtacagacaacgttctatcaatttcctgataggtaatatccagataaggcgctaatttaagaccttcattccaatagccaccgctattgagcaccattctgagacgttgccctgcataaaaataatcttcatcctgagccagcgttacagcatatttacccgcattttcaatcggcttgcccatagcatcggcaaaactgatgttaaatagcatgcccagaccatcgacatgatgaatgcaggcatatttgtccttgagctttttcagcccagcaagataacgtttagctttttccggtagggtattttcataatcctgctccatcatgtaatcccatgttgcgaaagccgcgctggttcccaagggatgattggcaaaattgctgtgggcatgaccgggtgtaaagaccgaaggggatagcctcccatcatggtagcgacacgattgcgtcccgtattttgtctgacgattttcagtgcatcttcaacaaccagcgtgccactggcattaaaggagatacgcccaggggttacgcatgaaaatatttagtggataattctttcatttttagagggacgctaatgaaagaattagtggatgtcttttctgattttccagacccacgttgtcagggaaaggtcaaacaccgtgttattgatatcttagtgatcgcggtatgcgctgtcattgctggggctaacgcctggactgatattgaacagtacggtcaactcaaaaaggattggctgagttcatttcttccgctcaaagggggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttagccgactaaaatttcatgcgtaacccctggagatacgccctttaatgcctgttctctcataaatagcctgacagactttttctgccagcagtaatttttcttcatggagaaaatccccactgatttgtggcaatttttcaaactgttttcgacatgcctgttcgatagtggggttactataaccaaaattacagcttgaatgccacatctgggtatcaatataggtatttccttccaaatcgtgaattaactcgccatggcaatgatcagcgataataggtcgttcctgataatgaaccgtatctccccaagaaagatatttctgatcaatttcacgtaaacgttcaacactcgcattattaagcattattttctccaaaaacagcctcagtgttttatacctttaacattccaagctttttttgttaactacaaattgaaatatattgggtatattctagaagacgaataatgtaatcgagtgactattcgagcatcgatttatccgccaataaatttataattaataaaaacaattatcattaaaaaatcgaaataagttaatcaatgaaattatctgcacttttgttatatacccatcgtcattgaagatgcttgattttttattcgtatcagatcaagatcgcgcccatgacaattactctgacagatgcccaaaaagaagccctcgaattgatgcacgatacgactcgtgatgggcgtgtacgtgaccgcatcaaggccgtgcttttggcctcagaaggctggactgcccagatgattgcccaggctttgcgtattcatgaaagtacggtgagtcgccatctgaaggattacgtctctgaggaaaaactcgcccctgaaaatggcggctctgaaagccgtttatctgccgaacaaacgacagaattagtggagtatctgacggcaaatttgatgcacactaccgcgcaaattgtggcttgtgtctgggcgcgctggcaggtgactttcactgtggctgggatgacaaaatggctccaccgccaagggttcagctacaagaagccgatgggaacgcctcataaatccgatgcgggtaaacagcaacactttattgagacctacaacgcgttgaaagctgaatgtggccaaaatgcgcctattttgtttattgatgcgatgcatcctacccagtccacaaaattaagttacggctggatgaggcgcggaagagagcatgtcaaagtggtcgaaaccacaggcagccggacccgccttaacatcatgggcgcactcaatttgcaacggattgaagagaccattattcgtgaatatccgacgattaacgcgaaaaatgttgtcctgtttttcggctcaattcgagaaacctatccgctttcacaaaaaattcatctcattctggatggagccggttaccaccgcgctgaaatagttcaattttttgccgaggtcctgaatatcgagttgcattatctgcccccttacagccctaacctcaacccgattgagcgattatggaagtatgcgaatgagcaggtacgaaataatatctatttctcggaggcaaaaacattccgtgaaacgctgcatcacttttttcatgtcacattgccagaaaaagcgaaagaactcaccacccggttaacagataatttccagactttaagtcctgcatcttcaagttaattgcgtatagtcggtaatacaatacactgacttaccgcgtccactaatgaaatcgaagatagtcctttctgagcctgaacgaatcacgttgcaacaactcgccctgaatcatcagcatcgggacatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatgaaacggagttcgctaaaaaatccgtcttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttgattacttaattatattaaaaacaaaaaaattaatattttttaacgtcctaattctttaggaggaattcatattttcaacaagctttccattcaatcagaaaattccattaatgccaatcgaaatataaaaacattttcatttatttctatgataaaattaattaaaaacattatttatttaatatcgatatttttataaattatattttatttaattgagcatagttattataaaataaagaaatatcaagccataaaagttttacatagaatgtatataaccatccccttaatctataaggaaccgattaaaagattaacaattaaattatttgcttattgttatcatagcattattggaacttgtactaatatccaattttttgtcgcattcttgccaaggcagtcccctcagaaaagcatcattacaatccctgggatcatggattaaaatactatcaatttatatccacaccaaacttttgcataagcactcttcttccttgctccgtcaatatcaattcgcggctatctaattgtctaatcgcccattttttctgtaaaaacgtcttaaacaacgaggcacccagaaatccgccaagatgaaaatgccgttcactccaatcaaggcaagaacaggcaaatttccgcctcgacgaggattcagtatcacaacacacgccaatagaaagcaaaaaatcgttccccctctgcgtcaatttataatcacgggttatccaatggttcgtaagtaggctgttatggatttttaccgcaatctcccctgccatatggtcataacaggttcgtaaaaaacgcagtgattttggtgtggaaattatggcgatatccgtgtgattacgattagcaaaatgcatcatgctttccagcaatccacttcttcgctgtgaattttaaaataacggtgccgtccctgtttaacgcagatcaccagtttcccttctgccagtcgatttaagtgaacactggctgtcgaaggtgcaacatcagatgccgcacttaattccgttgcagtataagcgcgaccatccatcatcagaaacaacatacgggtacgagtgcgatctgcaagcaccgccgcaatcgtcaccacactttcctcaaggttaagctcattcatatttcgctaatcaccgaagtaacaatgaaaccagcaagatatcttagggttttctgtccttcaaggagataatcatgttagctattatatttggggtcgaaattgcagaaaaccagagtgatcgttattttgacacctcagccacattaaagccgatattggaggcgatccccggttttatttccgtggaacgttttcagagcctcaataataatcataaatacctttcactttcatattggcgtgatgaagaagcagtcaaacagtggcggaatacttacccacatcgggaagcgcagaaattgggacgcaatggtgtatttacagattatcgattaaaagtagtgacggttattcgtgattacgggttgaatgcgagagaggaagtaccaaaggaagattgagaacattaatgcgtcaccaatggacaatcaataaaccgaccaaagaacatccaataccagtatcccgctgaaaagccaacagtaaccaaatagctgatggctttgagcttattttccggaaatcctttaatactcttcacaacaaatgtcaccataaaaggcagtaaaaaaacaaaacacaacggcgcagtcaataccctgtcatcatcaataacaaaagcattgactacatcacagactgtattgattccttcttccccgattgcccattcataatcaattgtagaaaaacatcccaccaatatggcactgaacaaaataaagacaacacatattaatatatttataattttcatgcttatttattcttcttgtctatataaagacaagatttcatccttgctcaaaatagctgaaatgtatcagcaagagtttatatcaaaaaaactaatgcattattctactttcctatcaaagataagatcttgatcacaagataaaatattataataaaccaaaaaatcggaatttatcatagagcagagaattcaagactctatttatggtatgagaatttatgagattgataaccgagtatgacaggcacaatagggagaaacagacaggctcttacccatttctccctattgcagagaaacagataagagcctgaaaagaaaaaatttataccaaactgacttaacgatacatctcaaatagagacaaaccttttaagtcagtgaaagctttataagaagcttgcagggcagcctgctgctgataatagctggaaatggacgatgcccaatccacgtccactaattcccctgtacgaactttattggatatgctgcgctcactgcccagcgagtccagttgttccagttcctgaagctggaggccgagaaccgcttccaccgaagagaagttgtccagactattgcggataccacggttggctttatttatcagctccatggcatcattcttttccgactcactggctgtgctgtacggcgttctcaacgccttgattgctaagtcaagggtagtaaaaacatctggctcaccagtgccaccatcgggttctttaatcggattggtcgttgtcgataaaaaaacctgctgccctgtatgggcaatgatcatcgagcggttatcatccactttctgggtaatttcttcatgtccacctttataatgaactttcccagactcatccgctttgaaaggtggaacgtcggttttgtaacccccaaagatatagcggccattaccatccgttttattaccaagattcagcaattgttgcttaaaaccttccaactgctgcgcataggatgcgcgatcctgatcgctctgcttatccgctgccgccaccaaagtctcaaaaacattggtcgcaaccgaaacgatatttgaggtaatgcttaattgagctgacatggagtttctggcaaaaatacgcgctgtcataaactgctgatttttcgattcagactgagaaaccatgatgctctgtgaagccgctaagggatcatctgacgggttaataacccgtttccccgtggacagttgctcaccatagcgcatccatttggattgggcacccaaaatcccatccattttttgactgtataatagattcgtacttacacgcacaatatcacgtcctttttattatcaaccgggcagtaattagcgaatgcccaaaatagcatcgaacaaggtcgtcgctgtctggatcacacgggcgtttgccagatagtactgatgcaagcgttgcagggagccatattcttcgtccatattgacgccagaaatcgattcgcgggtcgcatggagtttgtcaacgatatgcccctgtgtttcaacactgactttagcttcattggccttactacccacttgactaaccagtgacgcataacccccggcaaaggaagacttgccatcaaccaagcgctgatcctgtaggtcaagaaatttcttcgcattacggttatcactagggccggcatctttagcgctggcagtcgccaattgggaggaatcctggagattcatttccagtgttgccactacattactgacggtttttagtgtgtaggtgtcgtgatcctgagaatgagcggcatcgatttcaactttcagtccatcgaattccagcgcattgccattcttggtgacaggaattgccgccctgtcagaaacgcgctgtactttccaatccccaccttcatgtttgagggtatagtcactgcctttcactttggtggtatctgtgtattccaccttaatatcagccgttcctttgttattgctgttggaaataacatccggctgggtaaagttaaagaaattaacacccggtttacctttcagatcaaaaccgccgttttgcacctgattgaactgatcggccattaccagagccaattggttcaattgattgcggcttgagtctacgacttccctgcgcacctgcaatgcaccacccaatctgccttgggagataaagcgctcgtcaatttctttcgttcctacggtgccgttgttatagcctagcgtgatacggctgctgtcagtgctggatgggatcgcttccaatcgataggctttgctacccgataccagtgacatgccaccaccgaatgagacgttataaacgctcccatcctgctgggtgacactcacttcaacaagctgatttaatttgttgaccgcatcatcacgtttatccagcaaagccagcggttcgcccgtgccagtaccgcgcatacgggtaatttcgttgttcagcgtggcaatttcttcggcgtatttattgatttctctggcattctgctcaatttgggaattgatgctgttgtctatctgacgcagaaattcatctgcttctttgaaccggctcaccaaaccttcggctttacccagaactgttgttcttgccgcactgtcttccgcattgctttcagccgcacccagacttttgaaaaaatcttcgagggaattggaaaggctggtgtccttatcggccagcagatcattaattttggtgatttgctggttataagcgcccagtgcggcatgtttagtttgtgcagagctatgttgctggttgataaactcactatattcgcggttaatcgaactgacagccacaccattgccaataaaacccaccggtgacagggttccgttattctgtgtcagcacggctgtctgtcggttatagccctcacttctggagttggcaatgttattacccactacacccatcgctacctgcgcagcattaataccactcatggcagtattcataagactattagacatgtgtagatccttttacgttttcgttatgcctccgtcatgggaggtaattcactgctacagttatcggcaagattccctgatccttgaacaaaaacggcgttaatctgttcgattaaaacaggttgtcgaaatcatcggtataggcttttaccatttgattgccggtactctttaactgctggatcagtgataccaattttttggcgtaacccgggtcggtggcataccctgcactctgtaaagaatatgcgccctgctctgccgtcgttgattgcgcgaccttagcgtaacgcggattttctgtcagcagtttgacgtaatccgttattgcttccctgtaagagccataaacccggaaactgtcgtgcatcttcttcggttcaccctcaatgtattccgttgtcatgatgttggtgaccgcccctttccaattcttgccggccttgatgccaaacaggttatgactcggtttgccttccgctgtcagaatttcccgctgtccccagccggattccagcgccgcctgtgcaatgatcaataaatgagggataccgctttgctggctcgctatctgcgcaggcagggagagcatggaaacaaagtcagtgctgctaaccggtaatgacttcgattgtacggaacccttggaagctgccgcagcaaacggcgccgtcatggtacggtgcataaactgttccagtgcctgcttcggcaatgtttgcaggaattccttatccaacggcatcggtaccgttccggcctgttcgccggcaacgctgttcgcgttggaaaattgcttaacgatcatgtcggcaaaacccagccctttttgggaaagatcctgggcaatctgctgatcgtacatcgaggtataaaaacgcgtctgatcactgctcaatatgccatcctgtggcaacgaggaacgcatacttttcagcatcatctgaacgaaaacgccttcaagttcctgggctacctgccgtagcccttgttgtggttcctgtgataatctggctttcagtgaatgcagcgaattcacatcgtaagcggcggtaggcgtcgttaaaaaatcactcatcaaatgatctccagtttcgcccgcaaacaacccgctgtttccatcgcctgcaaaatggacattaaatctgtcggtgtcgcgcccagaacattcaatgcacggacaacctgtgtcagattggcactggcattaacttgctgtaatgcaccgccctgttcctgaattccgacacccgtattacgggtcactacagtattgccccccgccaatggggtattgggctgattaaccgccgtctgacgctcaacagtgacagacagactaccatgtgcaatggcgcagctatccagcgtaacattgcggttcatcacaaccgatcccgtgcgggaattgaaaatcactttggcatcacccgcatccacgcgaatattcaggttctgaacttgagacaggaaccttacctgttcgctgttttctctcggcaaacgcaactgtacagtacgggaatccagcggcgttgccgtcccttttccttgcaggcgattgaccgcatcactgatttgctcggccagactaaaatcatcattattcagttgcaggttcagcgttcctttctggccaaactgggtcggcaactcccgctcaatcaccgcaccattggaaatgcgtccgcccgcaagctgattaatcctgatactgttaccaccggcactgacaccagccccgccgaccaaaatattgccctgcgccagcgcatacacctgattatcaatccctttcagaggcgtcatcagcaatgttccgccccgcagactcttggcattacccaatgaggaaaccacaacatcaatattttgccctgagtgcgcaaaagggggtagcttggctgtcaccatcacagcagctacgtttttaagctgcatattcgtaccgggcggcacagtaatccccagctgcgatagcatattgctcaggctttgggtggtaaaaggggtttgcatggtctggtcgcccgttccatccagcccgaccactaaaccatagccaatcagtgcattatccctaacaccctcaatggtgaccaaatcacgaatgcgctctgccgaagcggtgccagacacgactatgctggacaatgccagtaaaagtgtaaaaaggctggcgactaatttttccatcctgaccatcctcttttaaaacggtgagatattcataaagaaacgttgcaaccaacccattgtctgtgcctcgttgatataaccatcgccaacatactcaatgcgggcgtccgctacttgattggagctcaccgtattggtgccggtaatggtgcgcgggtttacaacgccagagaaacgaatgaattccgttccctgattgatggcgatctgtttttcccccacagcatgtaagttgccattggccagcaatctatcaacagtcacggtaatcgtgcccctgaaggtattgttggcattggctccccctttacccccaaagtcactatcgccttccatgctcaaatccgttttgtcaccacccatcaatccctttaagaaacggggggtcagagcagccgtgaaaccggtttttccactgcgactggcgttggctgaggaatttttgctggcactgacattttcttgcagaataatggtcagcgtatcaccgatattgcggggacggcggtcttcaaacaacggctgataaccgtaataaaccggctgggaaacctgaaaaatagaaccatttggtgttggagcaggggcttcggcggggtttgcggttgtcgctcctttcaccagcggtttgtgcggtatataggcacagcccgccagtgacagtaccgccagagccatgctgatgcgccacttatatccccggtttttccgtaaactgggagagtcataagctacgttgttctcggcaacgggcattgtatccatcttcgatgctcttaagtttatcgcggaaatagccggagagtttcctccccagctatcctgattaatgattataccttttatcttttccgttgcggctttgctggctgcaacgggaaatctattgggtataggttataactgggtcagtttttgcagcatctggtcagaagtcgatacggctttactgttgatttcgtaggctcgctgaacctgaatcatattgaccagttcttccgccacattgacattggacgtttcaacatagccctgatagagcagccctgccccattgatgcccggtgcgttttctacagggacaccggaactgttggtttccagatacaagttctcaccgatgctttccagaccactttcgttgataaaagtggtcagcgtcagttggccaacctgctgaggtgcgttttgcccttgcacgttgatactcacaatcccatcacgagcaatgctgattttggtagcattgtctggaatgatgatggcaggcacgacctgaaaaccactcgcagtaaccagttgcccattttgatccacctgaaatgaaccatcacgggtataaccggttgtgccatcaggcatctggatctggaaaaggccctgtcctttgattgccacatccttgctgttgttggtctgtgccaagttgccctgactgtgcagacgctctgtcgccaccggacgagctcccgtaccaatctgtaagccagaaggcagattggtctgttcagacgacatcgcaccgggctgacgttcggtttgatagagtaaatcttcaaaaaccgcgcgctggcgtttaaaaccattggtactgacgtttgccaagttgttggcaataacatccatatttgtttgctgtgcatccagcccagtcttggcaatccataaagatcggatcatgaatttatcccctgtttccgattcagctcatggcgagaatttggttagcccgctgtgcattttcatcggaactgtgtatgactttcatctgcatctcaaaacgacgcgcattagcaatcatgttcaccatgctttctactggattaacattgctgccctccagtacacccggcatgattttcacttcagtgctggctgccagttcattgccctgctgttcccgcgcctgtggcgttaaatggaacaggccatcatcgccccgcaccacttggcccgcttccagcttaacgattttcagcttgccaatctgccccagcagtgtcggaggatcgctggcaatcaaggcagaaatggcaccatctgccgcaatagtaagttcagcctgtggcggaacatcaatcggcccgttttcgcccatcaacatacgcccctgcaccgtcagttgtccttctggtgacatctggataccgccgttgcgggtataggcttccgtcccatcgtcgagctggacagccagaaaaccaccttgtccgacagccacgtccaacgggcgggaagtataattcattggcccctgacggctatccatgccgggggtggaagcaacggtcaatgtgcgggtcggcagagtttcgccttcaatgggcacagaacgcagtgcggcaagctgggctttgaagcccggcgtcgtcgcattggccagattgttggcggtgacggcctgatgttccagcgtttggcgcgcagcacccatcgcggtataaatgacgtgatccataaaactatccgcctgagcttattaacgcatgctgaccagtgtttgcaggatctgatcctgcgtcttgatggtctgagcgttggattgatagttacgctgggcgacgatcatattgaccagctcctggctcatgtccacgtttgacgcttccagtgcgccgctgatcagcttaccgaagttacctgatcccgcagttcctacgattgggctaccggatgcacccgtttctacccaaacgttatcaccctgtgcagccaaaccttctgggttagagaagtttgccagtacgacctgacctaacacctgtgtttgctgattagagtagaggccatgaattttgccatcactatcaacgcggtagttagtaaaactccctgcggcatagccgttctgctgctggttggagatagagtcctgtgaaatgctctgctgtttgctgttgttgaaatcgatattgattggagcagcaatggaaccatttaacgcaggcacattgaaagcaaatgcgttgttagtcccttgaatgcggccattgccatcaaacttgacatcacccaatttttgagcagcagaacccgctacagaagtatcctgagcatgaatttgccactcgttatcttttgttttgacaaagaacacattgatattgtgctcattacccaaactatcgtataccgagagaccagagctatagttaaagctgtctttttttgatgaatcaaatggggtagccgcgatatcgactttcttattcatcgaattcaggttagccgtcatagtgacgttcgtcgtcgccttggcatccagcatatcccttggaatcgaaattggccccggtgccgcacccttttgaatttcaggcccatttgccccttgtaccgctggataaccggtcaacttcatgccctgcatattgatcaggttacggtctgagtccatgttgaactgaccattgcgggaatagaaagtactgccgttggaatccagcatacggaaaaaaccgccctgggtgattgccatgtccaactgacggcttgtggtcgtggttgaaccatccttaaagttcttaaccatgccagaaactttaacccctagccccacatctgaaccactgaatacatccgcaaaggccgctgaactggatttaaaaccaaatgtcgccgagttcgcgatattattaccgataacgtctaagttacttgctgcggcattcaagccactgaccgcttgtgaaaaagccatatgtcctccgtttaactaaagaatctgacgtacttggtccatggttaccgtacccgccagccctaaatctaatctagtgccatcttcaccccgtgtgacgccgctaacctcagcagaggtcagcggaagtgtcaccaacgcctgatcttgatagcttgcggaaacagtgaagttataggcaccgtttatcacttccttaccgtctgcgtctttgccatcccactgaactttatgtacaccgacattcactttttcagcttccacttcccgcacgacgacaccctctttatctctaatagtaattttgatgttatcagcgggtcgggtcagttcgaaaccgaatggcgatgtgctaataccgttttcttcatcgggaccgactaaaatcttatcgccagggatcataaccgttcggccaatcagcattgtcgtttgcatcgcctgattgccttccatctgcccaacaacagcgcccagcgttttattgagcttttcaacaccctgaacggtgctgatctgcgcaagctgtgtcgtcaattcattgttttgcattgggttggtgggatcttggttcttaagttgagcaaccaataaattcaagaagttatctttgatatcaccacttttttgtggttgttgtttgttcagggtggcgagttcgcctaccgttgaattatctaatgagtcattgattgaagagctaaccgccataatggaattcctgttactgacccagagtcaacgttttcagcatgatggacttggtcgtgttaagcacttcaatgtttgcctgataactgcgggaagcagagatggtattgaccatttccccgacgacatccacatttggcatacgtacataacctttttcatcggccagtggattacccggccggtattcgaggcgaaaaggggtgggatcatccacaacttcactgacacgcacgccaccgatctcctgtcctgccagagccgcaacgcggaatacaacttgtttggcacggtaaggctcgccattaggccctacaacgctatcggcattcgccatattgctggcgctgacattcagtcgctgggactgagcggaaagtgcggagctagcaatatcaaaaatactgagtaaagacatttctattatccttgtgactgtagaactgacatcatgcttttaagctgcgaattcgtcatcgtaagttcggcctgatatttcaggctgttatctgcgaaatggctgcgttctacatccatgtcaacggtatttccatccattgctgtctggtaaggcacccgatagagcagatccatttccaaacgattctgagactgagcagggatatgtcgatcggaagctagacgcagcttcattccatttcccgtcacacgaccctctgccatcacttgtttcagttgagcagcaaaatcgatatcacgcgcctgatagccgggggtatccgcattggcaatatttgcagacagaatttcctgccgctggttgcggagtgccagcgcttcttgtcgaaaatgaaaggcagcatctaatttatcgagcatatttctccctctggtctgttatgcagggcaagccctgtaactcattaaagcccattgtattaagctctaagcagctaacagaataaactcagaagaaaaagctgattcgatgaatagacacaaattggattgctatttatcccattaacgaataatcaaccgcgttacactattcacatccaacaggtactgaatattttttgaaatcatggttctcaaacagggtcagggtggtgaaaatgcctgcattaaaatttatcgggtttattacctttttccttagcagttttttgcatagcgctttggcattggcgagtaatttaccgcaatcaatcaataattatttcacacagattcaccacaacgcggaccacaaagtcaccgtgaaaattaaaacgcctgagcagcaatggccggtatgtgaatttcctgaaatacagccgtcactcagcaacagaaactggggcagcctgtccattcccgtcacctgcggccaacagcgccgttttattcaggtatacgttggtgttacgggttcttatctgatgtctaaccgcaccattcagcgcaataccgtgctgacagaaaaagattttcaggtaaaaacaggggctttggataaattgccaaatgacataatccgtaacagaaaggccatacaaaatggtattgccattcgcaacattcctgccggacaattcatcactcgtaacatgatccgacgtccgtggacgattcgcgccggacaaaatgtcgtcgtcaccgtagatggacatcattttcaggtgcgctacgaaggaaaagcgattaacaacgccgcgagttttgataatatccgagtccgcctgacttctgggcaggtgattaccggagaaactcaggaaaatggcagtgtaaaaatgatgttataaatggctaaagttttattctttcaagccgatataaccaacagaccatgatttacaggcatgccagcggtatatcgcctgctacctaagacaaatgaataatgcctgattaaaggattacaattatgagtattgaatgcactcaacctctactggccattgctgctgtgcagcaacgcaatgccaatgaaggtgctcagggcactcgcagaactgtagctgtcgcagaaaaaagcgctgatacgcaagttaagctgagcgaggcgcagaaaaagcttgttcagccaagtagccaagatattaatatccagaaagtacaacaattgaaagaagccattgcgaaaggaactctgaccatggacagcggtaaaattgctgatgctctgttcagagaagcccttgaaaacatggaatatgataaataagccatcaaaatcataaagagccataaatggaagaacttcaactcttgcttgagcagcaaaatgtacacttaaattcgctttcgaacactatggcagaagaacaacgcatattgagcgaaggctttattgaagcgaatcatttacatcgagtcaccgaacaaaaaacattttttctctcggcactcgatcatgttgaacgaagacgccagcaattaaatgaaacgctgaaagtgaacgcaccctattctagccatgaaatactggcggtattatgggatcaaatcagccaaactgttgaacgtatccgtaatctcaatgtacataatgggtttttactggatcaacatattgagttgaacagccaggcaattgctttcttgaaaagtcaccacagcccttctctttatggtgctgatgggcaagcccatcacaacacagcactgtctggccacaagatcagtgtttaattttgagtggtgcgactttacgtcgtcatatgtacagacctctttatttatcagtgaaataaggggtctgttttagctgctaacgtacccagccatcatttttctctgttcagataatcatctatcgattccagactttcactctttatcactcataactcattgtgaatgtcgcggtcgcattggcaacccctgctctaacgtcaccataccgatagtagcgtgcttttaaaggaatgtttacaggcccgcccgtcccggtggttgtatagtattttttttcaccaaggtgaatgggcatattcgttttaccatctaaaatctgaacaccaacaccatccctagccctctcattaaggccacgtttaagctcgataataccttgcattaggtcataagccccttgacgacctgcctctaaggtcataaaaacgctagccttgggttcacaggtcaaaggtatatgaaatagtgtttccgctgccgttgaacccacataaggtaattgcattgtcgttatccggcctaatgttacaggaattgtgctgttatcgacggaacaggttggggcgttaatcgttatcatacccgtggtgaatcggaattcttgagtcacactgggtattctggatccgcgcggtgcgacaatagctgcggctactgactgggaataacgacccggctttatcgggccaattttgtaaaattcaagtctgagtgcggcattcaggttgatagtgccatcaggccctatctcagtggtatatagttccctggcattcccaccccaaaaacggtccgcagttgttgttatcggtttttcatcgtgcgtatcatccacaccaataacgacatacccaataccactgtcacccaatttaaaaattttacgggagatggaagttatccccgaatcgtccccataggcttttataccgacagttatgtgagtggctcctactggcatatttgtgcaagttatcgccatatctgcccgagactgggaatataagctacggtatatttcatccctcgatatatgttgcggaatggacaccgcaacagtcgatatgattccactgcccccggaacaatcggcataaaccttaccgggggaaaaaaacaccgaagctaacagtaaccacggataaacgaataccttcatcaatcattccttatatcgagtctataaattattgtggtgccgtcatgcttaaagcagaaatatgatgacttcccgtcataactgacaatctgccttcatcgaaatcaccgccgcttcactttttggcaaaataaaacgcgctttacactgctcaaactgaccattaccccattgaacagacaactgcccctgctccggcacgccaccgaaatagacttctcctccattgccaacaatgctctgattttcagtgaggaagctgattgtattttcttcattcagggtagctattgcgccaaaaggaatcggtttacccagatgagtcagagtaaacagcactcggtgaccgatccgtgttcggaaatcagccactaccatcgctccttgtgtcggaatgacagtctggatattggactcaatttccacgccatcgccaaaagagtccggtgacagagcgatacggttatggtgataaggactgacatagggcaatactgcatggcctcgtccatccgtttcaaccccgttatagccgttaaccttaacccctgctgctccgggagttttgaccaagacaatcgtctcacccaatgattgagacaaagttatgccatggcgatgagcgaccaatcctcccctgagtccgtagttaatctgctgcgagctattgttgtagttatatccaccggacagctccccataacgggctttatagttgagattaatattaccactggaattctgaccgttattaccgtaacgctgttgcagagagtaacccagaacattgtcatccagcgccgtaccactcagtccaactgattggttcatatcgccttggcgattatgattgaaactataggtagcccaactgttcggcagccagcggtcgagcggaacttgtatattgaatgccagttggttatcggctgttgagttacctgaactcatattttgggtgtagttcagggtataattgatatcggcataattcacactgtacccgacatttaaattccgggtcgtgccgcggtttccccaatcatcctgcaaataaccggaaacatagacgctgccataatccgacaaattttgactgagattaagctgaaatttatgtttacgttgatatgacagctcatcatgtgcagcccagttattgacgtcctgaaaatcataaaagtgcggtgaagagtagtggtaactggccagcgacaagcgagtccccgtctgctcgaagtctttggtatactgcgaccggtaaacccagccctgttgttgaccttcattgataatatcagcctgtgaccgcgtgatatcaaaagataaagaaccccaacggccaagactgtatcccacaccaacgacataggcctggtagttcggagacagtaacgtaccgccatacacagttgtggcatgtggcaggccataataaacttcactctgcataaagagcggctgtcgagtctgatcgtgtgaagtgcggtattctcccgccgtcagactgtatttgaacccaccttcccgtaacataataggaaccgacgaaaagggctgaacaaagtgcctttcacggccgtccgcttcctgaatagtcacatccaaatttcctcctgaggaggccggataaaggtcatcaatcacgaaagccccgggtggaacataagcctggtaaatcatgaatccgttctgacgaatagtgatctgagcattgctttccgctattccccgcactatcggagcgaatccccgctgactgtccggtagcatattatcatcagacatcagggtaataccgcggaaagcaaatccgctaaacagctctccacgtgtattggtttcacccatcaccaattggctttttagcagatgaacatcacgttgaagatatgtgttaaggttttcccaacgtgactcgccgccacggctccggtggtaagtagaataattccgtaagcgccaggcgtcccagtttaatccactacgcaaattcatatagatactgttggttttagagccgcttttactgcgagtttcagcaccgttaaaatcgtaattcatccatagcgccgattcaccctgttgccaaagtgacgaatcaatcgcaccgcgcgcttcagccgtcatcgccgcctgaggaatactgataattagcgtttgttgaccaagctgtaatgaggtactggcataagggatgatgtcagccaggtcagtgacctgcatttttgagttcaagactgggaaagccgcaacattgactccccagtcggccagttgttgaactgataaatcgggttgaagttttctcccggcgtccagtacaaactggatatcctgagcacctttattctggccattaacacggatatcaacatggtatgtccccggtgcactaccgcctttttctgcaaaatagctcaaatcaggcggcggtgcagacgggtcatgaatttccagagcatcgagatcaaaatagtcactggcatacccagcgacaggcagaaatccggccaacagcagcaatattaactgcgcacggataaaaggagtaatcaaactcataacataaaatatcttctgaatgataggtgattacaaggatgataaggtttgatgctgtggctcagtggtgccgccaaaatcattgatagcccgccaagtcacggtattaccggaacctgcgggtaaaggccattgacggcggctgaacggggcgaccataccggcttccggtactggattattcccgaccgtaatgttgtggaaagagatatgaaaaggggttggattctgcaccactaattgcccattctggcgggaaaaagtcagttgttgataggcattatccgccagtttttctgtcaatccggccggccgataaaagagctttatccggttctttaccgatatcagcaggcgatttgcatcatttttttccaccgcaggaatcgctttaacgttcaaccagaagacagattcacgatcctgtggtaaagagtcatctgtcaggataattcgcagacggttttcttgctcaccatccagacggaataagggcggtgtcactaaaaatggcgctttgcgatccgatagttcggtcgttgttgtaaaggtatttacccaagactgaataaggtaaacattctccttactatcgttgattacggaaatagttgcttcacgttgagatgcttcataaatcacccgggtactactgagtgctattccggcatgggtgggggcagaaaagacaacaggcagggacagtaacagtccgaacaaaaaacgttttaacataacaatatccctacacaaactaaaaatgagagacacccccaccgaatgcggtggagatatcacaaaagcaataaaaaaacagtaaatggggaatgtaaggaattactcgtagtctagtgtaaagtccgtagaggctttcactgtacctggcgtgacagttgcccctgtagccacatatttagccttaaattcaagtttagttacatccttagtcaccggagtacttttgctaagctcccccatattaattagcgtactaccatttttctcataaataccaatgccaacacccgtcgctccaccactctcagagttaattttcagcagattgccatcgatacgatctttaacaccgtcaaacttcacctgcacattagccgaaccacccactatcccgcagtccttcagattaatgctaaagagagtgtcacccccggttttacctttttctgcaagggcagtcgcacctacttcaggtaggttgacaggatcagcagttgatgcatcgacagtacatgtcgccttagtaatcctaccgttaaagtcaattctgccatcggcagccaatgccgacgcagccatagatccagaaataattgctgcgataaataattttaataatttcatttttattcctttaattacagatataaaaattctcccgaccgaaatgaaaatacctattttcggttaagaaaattcaataaattttaataattgatggttgtgtttttaagaacaaaactaagagtatgttcctgctaataaagaatggtattccttactagagtctattaatacataagagacccttcaatagtgcgaatgatgccgacaaacgtaatattggattactcaaaataggtaagaatatatcagcaatctttcaggcaaccgcatagatgttcagcttggttgtactgttttacatgttgcgattatatattcccaagattcaaggcaacttgccttaaaaactaatgagagctgcttttatacgcacaatcaattttttgtaatcagctaaacatctggtcaagaatcctgagcttgacctgatgacttatgcctattatgtataaatgatgtgtcaattggtgaggtgattaaaataactctatccatatgttttataacaaatagtcaaccttaaataactgtccatgtcgggtttccatacctataacatctcgcatatttgattaacggcattatttttaatacgctttaattaaaaaattccactttagtggcaggaggaagatacaccaactcattttgttattaaaattgttattaacgatcaattaattattattgataggtatttcctattgatattaattaattgatcgctgtggctaatcttcggattcttggttaataaattaattatttgtataaaatgagactattttcagtaaaatttattgtttacgtacaaattctatctattggaactacctacaaataacttcgttcgtggtagccatgaagtgcggcgccataaaattgatagcatataaatataatttttttaaatcatcacttattaaccatatgacagcgaacaggataagataaattaacattaaaaaaattcattgtgaaaatttgaaagtaaatctgttaaaagacatcgctgagttcgttaatgaatctattttaaggggaggataaaaaagacgattaaaaacgccttctgtttagtttattacttactcttatctactggcaaaaacggaataaaagcattgccacccaaatattgaggtgtcacaccattccatttatttacctgcatttttcgaagcacctgatgctttctctcggttaagttttttcatcagttttttactgcaaatgcggcttcggtaaagtttttatctgcttctgcggctttttgataccactccagtgccttttgttcgtctttttcaacgccaagaccagattggtataaatagccgacattaaacatacctactgcattaccgacttttgccgccttaaggtaccattccatcgctttttgatagttttgtggtacaccgcggcctttacgatataaaataccaatgttattttgagccgttgaaaggccctgctttgatgcttttagataccactccatcgctttttgataatcttgtggcacaatttcacctaattcataaatcggtcatgataccaatttattgatagtgatgaatgtttaaataataccctatggccctgtcatgtatttctatggattttgaaaaagacaaggttttgcgagtcagtcttgctaaatgttgacgaagattcagattatgtttctctatgcgttgtgtataacgcttactgaccacatgccgcttccccgcccgtgttttttcataacttctcccgccatcggtcatagagatcacaatattgaagggagccagtagcgtcatcagacgcatcaatgttttctttgttcttgggtcaaaaacgtgggcgattactttccgtctgatccggtcgtaagcataaaagagccaacggggctgattctttgacttcacgtacgaccactgctcatccatttcgcaacagacaatcacttcagtgccgggagcaatggcttgtgttaccgatttgggtctgagctttttaaatggcgaaggacagtattcagaccaatccccatcacacgggctgtcgcccggcatcccattccattcatggccctatcgacgatttgcttatgtgtaccgggacgacaagcggcataagtgaattcccgttgccaagaatgacggcaggactggcaaagataacgttgatgaccagagcgagagcgcccattacggtggatccctttaactgcacaacaagatgggcaggtcacatcaatctttgccatctgaatgttttccaaatagacagactatacagggttcaataaattgatgtcatgacctgatcttccacataaagcaagatgaaatcgtcttgctttacatgatgcgattcgtcgtgggcttacgctcttttacccgtcaatgtgaagctaacatgatgacttgaaataaatttcttccttcggtaacaacgcttgagccagatccaacttattgtttcttaccaattcatagatttcatgtgccatatgtgtcatgtcactgatattaacaatccattgattaacataattatctaccgctttattacgtaaaccgatttgtattgttctctgttctaacttattcagtaaaatatctctctctggatcccattgaacaacgacatcactgttttgtactttctctttccatgcatccattgaatcaaaaaattctggatcatagtgactgataattccctgccggacaatttccctgaatccttcgtgggtgatatcaatggctaagatccgcgtttgcccactgtctttcattgcccatcctgatcggtacatcatccataaaaaagagggtttgatccatgtcatgcgagtcatactaaaaggaggagaaacgaaagtgccatttttaatagcactgtcagcgattgtatcagaaaaagcctgatataccctgatatattcttcagtgtaaaatgcgcgaattgggttatttttatgtgaaaacatattatcctttctaattatcattaatttataaaattccataaagtatggaaacaattaaagattatgatccatttatttatattacatcaagaatagatttaataaaataataattttaaaaaaataaatacttatatttatttaaatataaattcaatttttatatattattttacactcaaaaatagtgcattatctataaattgcattagaaggaggaaaagccaaatgggatttaatggaatgttggagaatgactggccaacctcactcaaacagtgaagttggccatcatgctattaacgtttatcttgctccaccaatcgttgccgtcattctgatttggcggttatcggtgatttcaaggttagacagcacaaccaatcggggcagtacgcggcgcaggaaacgagacaacagcggacgcagtgcatgattgaccagcaacacgggcggtgcacccaacatttcctgacgctccagcgcttctgccgcctgccgttcgaggctttctgccaagccgggctccagccctccaccgctttgcaatgcctgaagcaacagacgttcaagacctgcatccagcccaataactttgatttcatccgccctggggaaccattgctgggcaatggctctgccaagcgcaattcgaatcgtggcggttaattcataaggatcggcttgtgttggcgcatgttcagccagtgtttcgataatggtacgcatatccctgatcggcacctgctctgccaacaagttttgcaatactttgtgcaaggtggtcaagctcaccacgtcaggtatgaaatcttccgtcagtttcggcatttcctgactgacacgctcaaacagttgctgtgcttcctgtctgccaaacagttcgctggagtgttgagataacagatggttgaggtgagtcgccacaacggtactggccgcaacaacggtataaccctgtacctgcgcctgttctcgcagggaatcatcaatccagaccgcagacagaccaaaagcaggatcttgtgtcaaatctccctgtaactcgccaactgcgccacctgggttaattgccagccagcgtcctgggtgcgcttcaccacggccaatttcgacccctttcatcaaaatacggtaactggcaggtgccaactccaggttatcgcagatatgcaccaccggcggcaaatagcccacttcttgcgcaaattttttgcggataccgctgatacgccccagcagttcaccattctggcggaaatctaccatcgggatcaaacgataaccaacctccatgcccagtggatcttccagttgtacgtcagaccatgaggcttccgcagtttgttgctgttcctctgccgccttcatctcttcgtgctgtgccgcaagcggatttttgtccttgcgcagcaggtagtagccgaaacccgctaatgccgccgtgaataataggaaaacgaaattaggcattcctggcaccagaccaagcaagcctaatacccccgcactcaacagcagcacccgtgggttgttgaaaagctgagtcaccatttgctgaccaacatcttcatccgtcgccacgcgggtcacaatcacacccgccgctgtggagataatcagagctggcaactgagctaccaacccgtcaccgatggtcagtagggtataagcttccgctgcatctcccagattcatattatgctgggcaacaccgacaatcagtccaccgataatgttaatcaccagaatcatcaatccggcaatggcatctccgcgcacgaatttactcgcaccatccattgaaccgtaaaagtctgcttcctgtgtcacttcggcgcggcgttttttggcttcatcttcaccaatcaagccggcgttcaaatcagcgtcaatcgccatctgtttaccgggcatgccatccagtacaaaacgcgcaccgacttctgcgatacgccccgcacctttggtaatgaccataaagttaatcaggatcaggataacgaaaaccacgataccaatcgcgaaattaccgccaaccagaaagtgtccgaaagcttccactacctgacccgctgccgctgaacccgtatggccttccatcagaatgatacgtgtagatgcaacgttcagtgacaggcgcagtaatgttgagaacagcagaatagtcgggaatgcggcaaaatccagtgtccgacgggtaaacatcgccaccagcaagaccataatggaaagtgcaatgttaaaagtgaatagcagatcaagcaggaatggtggtaacggcagcaccatcattgacaagatcatgaggatcagtacaggccccgcaagcatttgccactgggagcctttcatattccccggtaaacgaagtaatgaggccagattagccatgacgattattttctccagcaaaatccagtgcagatggcaccggcagattttcaggtgttttcggtttcaggccgccctctcgtttccaacgtttcaattggtaaacccaggcaagcacttcagcgacggcagcataaagcgtcgcaggaataaagccccccacttcggcatgacgaaataacgcccttgccagtggtggggcttccaataacggaattcggttttctgcaccaatttctttgatgcgtaaggcaataagccccgccccttttgccaatactttgggggcgcccatttttttgctgtcatactgcaaggcaacggcgtagtgggtcgggttggtcacaataacatcagccttcggcacatcgctcatcatacgcttacgtgccgccgcccgctgttgttgacgaatgcgtgcctttacatgtggatccccttcttgctccttgaattcatccttgatctcctgacgggtcattctcagctttttcaagtggctgcggatttgatagagcacatcaaacgccaccatcggtatcaacataaataagacaatgtaaccagcaaagatcagcatcatcatggcatcactcaacgccatcagcgggggctgggcagtcaagttcaacatggccggccaattcagccagataaacagggctgctccaccaccgaccagtgaggctttcaagatggccttgaacagttccgccagtgcgttcatggagaagatcttcttcaatccagaaatcggactcagtttagctagatcaaatttgatagattttgaactgaatatcagcccccccatcaatgtcggtgcactgagggcaaccagaaccagaccaacgaatactggcaacaatgcccacactgcctgtttcaataagcgaccgacctgctgaatcatctgcttatcgttgctgaccatgttatggtcgaagttaaacccttcgaataccatcagtgaaagttcattagtgatcgaatttccgctcatccagagcaggcttacccctcccgccagcatcaggatagaagtcagttcctttgaacgcgcaatctgcccgtctttgcgggctttttcccgtttatggggcgtgggttcttcggttttttcgagatcgctatcttcagccacgactttccttggtgagcgttcgttattgcatgcagaaaaattgcttttgggaaagagcaaataaaattgtgttaagcatgacaaaaaccaagaaattcaatggcgggaatactgcaaagtttgcagaggtatttggggaatcacacgataccagagcttggaaggctccggaatcgtgagatgagtgttacttataacggttctgtcacattaaggtgaggtcaggtaatgttctgccttttactctgtgagctgagcatgtctttaatacggaaatctttcaaacgtctgcattatcctgttgacatcatggctcagtgtgttcgctggtatctggcttactcgctgagtttacgaaattgagaagaaatgagggcggaacgagggatgttgccgccgtatagcattttttccgtaaagccctacgccaaataaaggttgaattaatttcaaaataggcttggtaaaaatccgccccaacaaggagcggatttggctttcttagttatcacatatgacatgtggagggcaggggatcgttatcggcttcgatgttaccgaaaaatgaatatccgccgacgaacccttgtcacacccctgctgggaggcatgcagcgtataccaccctatatctaactggaatccgtcgtatttccagcccccatcattccccaccctgacccggctcgtggtcttccatcccgacgctctcacgacttcaagctccacctctgcccccggtgttcctacgccgtacatcgttatgtgggctacacgcccccaaggtgagcgagtttcatacaccacacgattgccgggttccagcaccctgaaggtattctccctgatggtcacctcctgctcgactgtcggtcccaccggacggccatcaggcgtgagtgacgggaacgccgtcaggtgaaacttccctaaccagacattatcaaggcggcaactccagcttcctttcgccgatgcttgggtggtcccgcaggtatgaccggcggaagcattcagggtaatgtagctccccggcagggctttccccgtcacgaaggccgacgttggctggccggtgttcggcggcggacaaaatgccggggcagtgctgttgatgacgatatctggcatcccgtaaatgacctcatagtgccgggtgaccggtttgccccagctatatccctccagcgtttgccgggcctcaatctcataccagcccggcgaggagacgaaacgcgggcaaacccagttctgctgcccgtccacaatcgcgctacacagcggcttaccggaagcggccacggtcacctgagccccggactccccctttcctcttatgtcatacgttggcgtggtgatttgaacttcctctgccggttgcagaacactcaggtcctgaatgcggtaagtgacacggtaatcccgcatgaccaccttgcctgagggtacctcatccacccattgctaggccagcagttggtaatccccctgacgggatagctggcgttcctggcaggcccacgtctgatgctcatccaccgttgtctcacaaactggctcgcccgccagagtcaccgtaatgcgcgcccctgtctgccctgttccgttaatggcataaagcgggcggtcaatttgcgccccttctgccggttcaagcacgcgcatctgcaggttatccccataacgcaccttaaagctccgcgcaatccggctgccggtatcatcctcaatgaccgcacggtaatccccaggcactgcactgtagggcccgcatgtccaactaccactggtcaggttcagctccgcagtgcaaccctcattgccgccaaacgcatgcaccgtcaccgacctgccgttagccggcagggtgccactaaaggtataagacggggtttttatcaccgccgcctctccggggacgttcaccgtcagcaggcgttcaccgtcagccccctccacctgaaaggtaaccttcgccgtggattgccgagcctggcccaaaaaggcggttgctaccagagtttgttcccccttgcgcgcggtgttcaggcggtcacgctctgtccagcgcccctctttatccactgtgaccccgttctggcatacctgctccagcgcctgctctgccagacagattgtggtgcccggttcgctttggcccgccggcacaaccgactcttgataccggtataccccaccatgatgtggttgggtgataaccagcggcctgatgcggtcagtctggacgtcaaaggaaacctgtgccgttgagtgcagctgattattgataagctgttcagcggaaagcgtgtattcccccttttccggctgatagggcccgcaagaccagatccctgatgcctcaacatcggtgttacacttcggtgtcccgccaaaactgccgagatgtacctgagctctcggctcacccgtgccggtgatggtcaatggcagcaccgtgattttggcgccctgccggggggccgtgatattgatacgggtctgggtgatgtcataccggcgcaccaccgccgaggttctttcatacatggcatccacgttacccggtgcagtttttttatactgtgccccatacaagaagaaggtgcccgccagttttgccgtcatggccgggttattggggcaggcccatgttcccccgccattaaccgtggtctgacaaatcaggttgttctctggaacctgccccacggttaatctggacgacagcaaatactgtgagccggcaatcaggataagctggccgggcgtgccttcgcctttaatggaaatggggttatctacccggtactgggcattcagccccggctcagtaatccgcatcggcaccgtaaacgtccagatgatcggatcgccgacaagctgaccgtagtgggtttcctgtaatgtcagcgtgtagatatctcccccgccgagtttattcggattgatcgcgacgccccaaagggtagcaggcagtccggcaactaaagacacggctccactgacggccccgaaaatcgaacctaacagccccacgacagcaactccagcccccgcaacgacaccgccgacagtaccgaatgagccaaaaagctgaatggtgccatccggatcaacggttgtattatttttggggtaatcacttttaaatttgtccttgtccttattatttttctttttgactgtcatgtaagtagtatttttagcaactattttacctgctttcattaattcagcagttaattcataagtacctgcggtgaaaataacaggcctactacattcccactaaccattatcattgacgatggctcccgtgcaaataacagtttcttgtgcactgtttaaattattctttccctgactttccaaagaaaatgtaattttgcgctttttaacatcaacttcatcaccgggtacattagcatcacctgatacaaaacttggcgtacctacagtattcacgtcgcccacagaaggagttttaatttcaacattaggagttaatatttgaaaatatgttttatttagaattgagtagtaagtttctttgaaattaggcaatcctaatggatgatatttatctgttacctcaagataatatagtccatctttcaatgtaggtggaagagtaatgctccaaattggaaaatttttcctacccgaaaaatttccatattttattggaagttccgaaaactccctactatctttgaatggaatctttaagtaaatattattatcccctttttcagaacacagagaagagcctggaggtaaaggcgaatcaccccctttcttcatacatatagagtattctgaaggtaagattatatcattattcatatcagtatagcgtttattatcaccaccaaatccagtaattacattattttcaatttcagcagacaagatacttttggggtgagagatatcatgcacttcattaaagtctggaggaaaatatcctcccacagactcataattaatatcactccacaattttgggtcaaaaggatctgctccttcaatcttttgtattgcacttatgttaaagcgtgctttttcatgcgaattaagattatctcttcccgctgatatattacccaaataaaaatcacctttaccatcagtattatttttacaactgaagcttttcctgttaaaaacacatacgacctttgcatatttagagtaattcacatcaaatataagattttttctgtatatattattcttactttcattactctgttcgatttttaactcggtatagtcttctggttttaaaatcatattaatcccgtcaggaataatcacctttcctatattttgcattgctgttattttaatatcatattgtttatttatatctccagatttaataataagttgataatctatcatacatgaccataccccatcctcacctgtttttattaattctttatcttcaaggccgttacatattttatcttgtgtatagcttttatcgctggagttagacttcagaatcaatttaacattagaattaggatctgcgtatccacgtatgataaaatttttagtaagtacaattgatttatctgttggataaacgatactgaattcttctttttcaggtgggattttggcttgtataatatcttccttccatccccgagaatcctctttagattctctggctttaatcgccactttatattccttattttcagtaacaaattcagtgaaataactgtcatatggaatatcacacttccattttccaaagttatcaactgaatgttctttcttcatattatctagatctttacatttaattaccttattttttttattgccaacagaataatcaagtttgagatcactgtttggacgcccaaaccccttaacaacaacactcttacctcttctacttaggcgactattccagtctggactctcaatccaaattttattcatagtccgagaaaaccaactactcatagacctttttttactcaggccaatatcaatatactttccagtaacatctgacataacaaaaaaatgagagcgactatcactatcttgatattttttttcaaaataagaatatccccatgatacaacaccaataattgtatcatcccaaataagtgggccacctgaatccccttcttgtgcaattcctggttttaaattttcatttaaattttcctctaccatcaatccttgattattacgagagtctggagctgtggtgaacattttcacatcagccctatattggtctcctgaattccttacttgcgctcccgttattttattaattccgaaggaacaatacccataaatagaagcatcataataactgtttctaaatttttcataggcttcatcataattaaaaaaacgacgaacatgtccataactaactaatataacaggactttccaactttaaaatagcaagatctgaaccgttgtaactcgcaataaaactatgaggtaatgcagtgctaatctcctcatttttataattttttatgatatatttttttatatttttcttttggcaatgagcagctgtaagaacatactttcgtgcaattactgaaccactacataatgcatattgcgtatcgctattcgattgaacatatatattgacaacccaaggtttacatttgttaccactaccagaatcgcagcttttctcccctcccgcgatagcttttattggctggtatttcaatgcagaattagaaaaagcataatcacagaaaaataataataaaagcagtataaagaacgtcctaaaaatattcatttaacccccctcttacccccaataacacctaaatttatttatacctttttcacaaagacattcaatagtataaaaaaccttaaaataatcatgaagatctccttaagaatagaatgacactccatttgtctttcaaattgaagccaataaagctgcaattttaaatctatttagtataattatttttttcaaaacaagtcatattgctcgttcctcctttacactccaatactttatcttctcgtgccttatatcttttgttatcggatatttcttgaatagtaaaggtatatacccctcttttcgcataatatttattgttcgatttccaatcaccccgttcatcgggtattatttcatctgctttttcaccatcaagcaagattcttattgtagggtgaagagattctttaaaaccattcgatttatcgttttccttttcagaaatcatcggcatagaggttccataaaaatcgataaacactttatcgggaaattcatagttcacagaaaattcttttgatttaagtataataacttcatcctcactgtttttgattttaacctgatctgttccggtattattcgcctttatttttataaaaccattaggtgcgtcactaatttcagctagccaatcatttccagtacggctatttaaatgaattagattcttgccacctgaagaatcactcgcactaatatcaagaggagtgttctgtgtaacttttccttcaacaccaattttattataatcttcacttattgaagaaatcatttgatacattgtaggttttgtaatttttaccggacaatgtgatacatcataattaaccgatcttttccctgacatatctggattatcttcttgatctgactggaaatatatagaggctttataataagtaaaacattctgcgtctaaaccttccacactccatttccctgtttcaatatcaatgtttggtttatattcttttaccatcccaacaccttttttatgttcaggatcagaaaagttagctatcttcacactcagttcattcttgaagaaatcatttgatacattgtaggttttgtaatttttaccggacaatgtgatacatcataattaactgatcttttccctgacatatctggattatcttcttgatctgactggaaatatatagaggctttataataagtaaaacattctgcgtctaaaccttccacactccatttccctgtttcaatatcaatgtttggtttatattcttttaccatcccaacaccttttttatgttcaggatcagaaaagttagctatcttcacactcagttcattcttgatatcatctaatttataaccattaattagtccggataaattatattttcctgaagataagagctgattttctttcattgatgttatggttgcaccacatggtgtgccgataatagttacatctgaatttgcaatatccttaatgctaactgttcctgatataccacaattcgcccagattttcgcactccatttatcttcagcttctcctgtattatcaacttgatatatattattatcaaaacttgtgataattaaaggcaacgattcgtcctccatgagtccttgccctacaactgtaatataatttttttcagcataatgctttctatcaggggaaataatttttggtggttcccaattgttatcatctttaatgcttatgttaatatcataagagtcagtataaacagaattatttaaacagttcgatgtaccacataaagcgctggttacaagatcacaatttgctgcattaataatagttctccaaactaaatatccttcacttggaaacgacggcacggagtttttaatctcaaaatcacatgatttgtattctacaccttttttataagtaataattttccattttataatttttgcttctcttaagcagtctggccaagcattactatctttagtataatcatatttaatttctcccgggcttaaatggatatattggtcaccactgtttttcatacaattagaatctaaaactttaatttctaaatcatcatttttactttcgtttttaaatatcagagcgtaatgtctttctagattaattatgttttttttaaatttataatttttttcacttataatattatctgcactgattaagttatctgctctggctttattaaaggtgaacagaatgctaaaaaacaatgcaatatataaatttattttaattattttcatgatccttccctttaatttaaaatcaacattataacataaataattttaatgatttaaattcgaaaaaatctgttatttcagtcttatacctgaattatcttgacagaaaaaataagatggacataaccgtgtagcacataaaataaagtatggtaaaaaaaatcaataatgtccaaaatataacttaagttttttataaattattggtcatgattccaaagcggtaatttgatattcttgtgtttttgaataaagatcttttgtcggtaacaaaaaacaacgtcattggcttttgtatacgtttgatataaaaagaaaataggtcatagcccatgtattcggttcgcgaaccgatgcaacctgccgcaaattgttcgacttactgacccctttagtattcgtttcataacaaccgatgactgagggggttatatggaaaatcgtcgagtcgtaattctgataggcaatagtctgccgctccttgttgtatcgccagaaccattgagtcatgctgtaccatgaatttatctggccgacgagttgggcagtttacctacccaaataagcgaataatctacagatggttcaaccgtaaaggtggacgtcgccgattgacgagggaaaagctgactctgatcctgaaaatgctgggttatccatcgcgctagaaaacgcattcaatgttcagttctcgctaaacatgtgtggggacacgggtctgtcaggagccggatacgatagttccgcaagtccggttctgaggaggagcctgcctaggtgactgggtaggtctactcacccaaaacccctaaatcttgataacagccagcatctcttcaacttcctaatccatgccaacctcaacgaaaccaaaactggcataaagatttttcgccacgagattattcggatcataactgattgctattgtctccaactgaactgtgcgcctgatttcatcaagcgccagtgatagtgctttacgcccaatacccttgttttgatggtttttatccaccataaaccgccaaatcgttattctttggtcagcatccggtacccacatgaaaaaaccaacaggctccccatccagacaaattgcacgcgtttggtataaagggtaaaatttggattgagcaagagatcacatattttccgcaatatagtcaagttggtcatcagtgactgataggtcgcagacagcttcataattgttcttgtttacgtcagttaaggtaattaacatacaccactccaatatgggattgtaagccagaaccgtcaaaaatattgttatattaatttaaaactgtttttttaagtattaatccaaatactgggttctcaatgactgggataacggcaatatcgaattggtctggttctggcaaaaagccaatatccattaaggcagaaaatcgtgacgttgccagataggcttcttcaatatcatcggcgtatatcaccatcccaaattcattttcatccaacgtcgcaaatcgacgattacgcgtgttaaatagcgcataaccgaccacatcaggatctttttcaatgaatcctaatgtatcgagttctttctgaagtcttttgagtttcttatttttcattataaatttccgttagttatcattagccattctgttgcgtgtcaaagtccgataaatcgtgggtcttttggcattaaaaaaaccgctcatcaaagatgaacggtggttaaccatctaaaatataaacttatatgaattctgtttattaagactcttatctaattgatattaatctgttttggttgctgttttcatttcgatgctatcagcgttaacgtcgcggatatgatctttggtcaagcgatacacgatagggcttaacagagcaagagctatcagattggggatcgccatcatggcattgagtgtatccgccagcaaccagacaaagttcagcgactgagtggcaccaatcggcagtgcgatgatccaggcaatacggaaaggcacaatggcttttggccccagtaagtattggatacatttttcaccgtagaagctccatcccaagatggtagtaaaggcgaaaatagccagggcaacagcaacaatgtaattacctcccggaatcaccgcagagaatgaggaggctgtcagtgttgcccctgtttcccctgtcaaccaaccgccagtgataacgatggtcagcccagtgacagaacagacgatgatggtgtcaataaatgtccccagcatagcaatcaaaccctgacggatggggttttgggtttttgccgtagcatgagctatcggagcgctgcccaagcctgcttcattggaaaatacaccacgggcaacaccaaagcggatcgccgcccagactgctgcacctgcaaacccaccttgtgctgcaacgggagtgaacgcagatttaatgatcaagacaaaggcttctggaatggcggtgatattgagtgccagtacgatgatgccggcaccaaaatagccgacagtcatgacgggaaccaatttgccagccacatcagaaatacgtttgatgccaccaatcaataccgcaccaaccagaatgaccaaaatgccagcggtcacggttttttcaataccaaaattgctgtgcagtacgtcagccacagagttggcctgcacggtattaccaataccaaaaccggcgatactgccaaagaaggcgaacagtgttcctagccaaatccattttttccccaagccatttttgatgtaatacatggggccgccaacgtagttgccgtttttatctgtttcacgaaagcgtaccgccaacacggcttcagaatatttggttgccatacccaataatgccgtcatccacatccagaacaatgcgcccggcccgcccattacgacagccgtcgccacaccggcaatatttcctgttcctattgttgcagacagcgcagtcatcaaggcattgaaaggagagatctgaccttcaccacgttgttcatttttctgaaaaagtaacttaaaccccgttcccaattttcggatcggtaagaaggacaggcggatttgcataaaaatgccaatgcccagaataccaaccagcataggtattccccatactatcccgtttatcgcatttaaccattgtgtaatcagttccatatacactcccgtaatctgacataacaaattagcaacaaaattgtttcaattaaataaagagcattttgggaaaataagcgaggacaattggttatcattggtaagaaaaaattgatcctgtgagttgagtcactcactctggtaacgatgtattgatcttccagacagcaattatccacccatcactaactcaaatgccaaatctgatttcgccaatttttatcttgcaatcaagaaaattaatggttttttatataaaaaaataggtattatttgcataataaatggtttttttgggtattgaaggattatcagtggcaagagtcgggtatgtcagagtgtcaacaaatgaccaaaatagtgatttgcagaaaaatgcgctggtcagtattgactgcgagcgcatttttgaagacaagatcagtgggaaaaccgctaatcgtccggggctgaaacgcgctttaaagtatctgcaatccggcgatactctggtggtctggaaattggatcgtctggggcgcagtgtaaaaaatctggtgacgttgatttcagaactgcatgaccgcggaattcattttcagagcctgaccgatagcattgataccagtaccgcgatgggacgttttttctttcatgtgatgagtgcactggcggaaatggaacgagagttgattgttgaaagaaccaatgcaggattagccgcagcgcgggaacaggggcgcattggtgggcggcctgtgctgtttaccgaagaagatcggcagcaggccgccagattgctggataggggacatagcagaaaacaactttcccttatttatcatgtttctctatcaacaatttataagtatttgcctgtgggccaggtgattaatcttccattacttgattaaaaagccacgatgttgtgagaattaaatctgacagcgacccagaatatggattagtcactgccagatttgagcgttgttaatgcgctattgcggctgatggtgtgggaaacgagtgctcattgttcctgtgcctttaataaagctgttttcagagactcttacttcaatattgttctcgttcctattcaatagactccaacgcgaggggggaagaattctctgatatttggtgctcctgcctgcctttgataatgaataccccatttttttcctcttggttgtaatgcataaaggcaaaggcagttatgttattcatggtctgtccattttcctgataaaaaccataatcaagataatccatggccattgccagtccttccccatgttcggcagcgtctaattcatgatatttctctctctcatgaccacctgagacatgaaatacccgtaattagcgagtataaacatcgtcattggcaggcaggggaataatcagtacaggcaatcggctgccttgctgaccgatactggcgatttctcgaccactggcgctgactagctggtaaagcgtgtcataagcatagtggttctctggttctactatctgattacaccagaaacgggttacctctgcattattgcgaatattcaggagattaccgaccggatcatagtgatagacaagatcctgcaataattgacgagattgtgagagatccacgccggtcagagacacagcattaagctggtttaatccggcggtatcataatgacggagacattttcccgccagattgtgatctttttctgattggctattttccgcccaaataaatcgttcaataatttgtggtgttgaagcctcgctcttccgttcactgacagcaagcaagcgccccggcagtgcattatcttcatattgccagtgtttgacgacacccatcgcactgatattcagtaacggacgaccttcgatgtcactcaaaatgacagtttgtccggcatccacactctctgtccgtaggacatcacccttcaaggcaggacagtaggtgaaattaggttttatggtgctctgagattgcaaatcaaaaaggcgtggatcaatgctctcgattaaaaaattatggggactgtattgatggcgggtgatgcgagtgtcagcctgctctcctgctgttgtacggtgataagcaatatcccgcactgacagccctcgattgtccatgacggtgacagtcggtgtacaggcatataaagttggattaaaaacattcatcgtattttttcctaatcagcctgaatcggatgtaaaaaagatgacgttaaaatgcggtcttaaccttccccgcctgcataacagggaaggttgaacgggtttactcagttgttaagatgttaaacgtgctgctgtgtcattttcatcttcattgacgacaaaccacggcataaacctgttttcacgccaaaatcctttcgcggtttttacctgatattcacgccccagaggatcgtaaaaatgggtatcggcgtacaggtcatcccgggcgctgtcatcactgacatagcgccaatcattaagataataaggcaggtaagctctaatcgcctgccctttgccgtcgtattctgtgcgaccagatactgcccagcgcgttgtggtattagcaacaacgggtttaccggtattatcgacaaccaaagaaccatcttctgcacgctgccatgcctctcctgcttcatgacgctgggcgctttgcaatacgcgaccaaaaccatcactcaatactatcgactgccgaagttgctgctgagaatcgctgtcataacgatctgtcgtgatcgtcatagcatgggggggttgtcgtggagtctgagccaagatttgctgtaatgtcacggcttccattgaagacggtgtctggcggttgagccaacgacggcaggccagttcacagatcaaaccgtcttccgttactacacccgcccggtgtaatgcgttccacaaagtttccccctcttttagctggccagtcagagactgttgggacagaggctgcatccagctatccggcacataaatgttgcactgtgaaaccgggatcgtcggttgcaaggcaagggctttttcgacggtatccggcactgtgaatggtttactctccggcgtcgagtaaccgcttattttgccattttctgtgccccagaaacggctggaagtcacctgccccaatgcattaaatgtcacgatgtgctggttgtcgttaatatcggtcaattgtaccgggagcaggaagcggtaatcgtacttcgcttgcgtggtcattcccgcgccatcttcggttttgacaaccacacaatagcgagtatcccaactgagggtatattttccggtcagcaagctcttgcgctggatgagtggccggtagaactgagaagcatcgccatactcggtgtatccctgccgagccacccataccttttcactactgcctgccacatcagaaatctgcggcacgagcaggtatccacccgccaacaattgttgcgtcagttcatcaggggcaatcacgccatcaaaggcgtgcagcgcattgtcatcaaaagcagcggtttctgtataagccacccgtacttgacgtgtcggtttttctgcatctccacccacgtaagccactcgctgctgccctaaatagataaacgtcttgtctttacctatcaggccgtcatctgccagcaggtcttccaatgtcagccctgccttgggaatgtcactttgagcgtcagtttgcgcataatgataaacttcgctgtatcggctatccgtcagacccagcacccaatcatcctgctggatcagatggtaatagctctgctgctgttttgtcagatatagctgtttttgctggtcgtcataactatcggcgaacagagtatccggtaacgaatccggataggggttctgtgccggtttattgcgccggggatagccccccatcggctgccaccaccagcaagaccgaagatatttgggaacatatcagcaccggcctctgccaatttagcagcttccagcgcagtacttatcgcgctggcagtagcacgcaaacccatagcagttatttcgcccgcgttgatattttcatcgtacagcttgctatagctgtcaaagcgtgattgcgccccttgtcgggattgtttcagtacttctttttccgcatccaattcttccagcgttttattctgcatctgaatgctgatcagcgtcagttcacgcgcttgattttgcagcaattcgttgagcgcttctgcatcctgacgttcaatgatcccctgcaaagtagaaccaaactgaatcagttgactgactatactcttcgcgttatccaacatgatggggaaacgatgaagtggcatttccgggtttggcagatccgtgcctccctgggaagcattcaccgccgcactcaacaaggctttaggatcggcaggtttggcgtaaatgggcaatgacagcggcaggccatcaatggtgagattatgacgcaggttatacaagcgctgcttcaatgtttgtcagtagccgttcagtttgtcattttgttgaggcaaaaataggttggtcagtgagttagcggtatattcggcgggctgtaccaggcgaattaacatcagcgcatgctgataatcctgttccaccgtcttatccgctgcggtttccaacgtgggttcagaccagttgctatccagcgccacaaactgctcatcccccaatagactcagtgcctgtatataccagagcttggcttcattcaaagtatcccgctcaagctggcggtaagccttgtcgccacgggcaatcagcatatcgagcatccgcatgaaggtagaaactttatagtgcatcggatcatcttgggcgacggcatcggggtctgtggaatccagcgggttagagttccacgaagtatcttcttccagtggccggcaattccaatgatacggcgcaatctcacctttgacgatatagccctcagggttgtaaacatatttcagccaatgattggcttcatcaaaattttgttcctgcaacaagcgctgcgctaccagcatcgggctgtaatagaacaattcccagaagtagagggagttggcgccgttaaaatccatcggctgatcataatatttggacagcagttcaaccttcatgggtggcgtacccgaaacaggggtatattccgtgaagacaatattggccttcttatcctcagatggagtaaacgctgtttttaaggttccggccagcaaaccttccttagcgctttttagaaaaacttgaagcccgtcacttatcgaagatggaaaatcaatcgtgttatagaaaggttctttcgtgctagttaatggaataaacagtttgatggtttgttctgcatctgttaacgacccgtcccagaagccgtaatgcgttgttgagtctacaccatctttttcctgataaagtgtgaccgcggcgtttctggtactaccatgcttatctggatcatatttgggtaaggtgacactaatatatcccccatctcccattttaggttcaggcagctgttgggtatccattgccagcagggtatcaatgcccgtttctgcccgttccaccatatttctggcaaataaggtattaatgcgggtacggtaaggccccattgcagatattgggctttagacgcagcagtattgagcgtcagcaaccctgactgttcattcagaattttctgtgtaacggtaaaattaaaggtttcacttcccagaacccggccatcatccgttttcccggtcagcactatctccacatcgacttggttgtccttaaattctgtcagtgggatagtgaattccatatcatggaagttatagatcatttcttccaagttgttgttgggcagatttatgacagatgtgccagcgttaaactctacaggtttactgctgcctgcactggccttaatcgtgatatttgccggcgttacagcagtatcgatatctcttggtgatgcgaccttcgtagaaatacccgcgttatccgtcagtgtcatgttatttttcagcgcggcggggttatttttgctgtcttcaacataaccataaggtttttgagcattttcattaatgagcggatcgtgccctggcccaatatctgccttgacataagatgatgaactttctctataaactaataaacgccctgttgacaatttactgacattgccactgtattgataaacgggataaaagagattgttattgcctgcactctgattctctctgtcaattttcaggtcttcgtaaacaataaatttatcacctaactgaccaaatttttgcatcagagcacattggtgacgctgcctgccttcaaccccgttataaattacccgcaggtcggcatcgattttcaatttgatctctgatgaagtagttccgacggtagcaatggaagcaattttactgtcataaaccatactcagagaataatcgccccactcgtaaccactactgactgcaacggaagacggataatcataatttgccgcataacggttatttaaccatcgttgggtcaatgtatcgaactctcggtaaacgctgttttgataattgccaatctcatccttttccatgacttttgtggtcatgtcagagtaaatatacattccctttgttttggtctttgtgagatctttgtttccctccgtattagcctgtttaacatacagtaataaaagtaaggtactttctcccgtatattcagagcaatacatagccagattggccaagtctgtatcgttatatgcgctgaaaatatcgctgacatctaacgtgataggcgtattccatgtgccatcatgtctgatatgagcgattttgatttcatatttaatgatatctttcgatgttattacgccctccttatcgctttctgaaacagtaatcactcgtttttccagccagataatatacaggcgggatttatagataaccggcttaattaagccctgatagggattgaccgggctgtcaatttttgcccattcactccacgcgttggcggcaatcttgccttgacgggatttgctgtgatccagtttgcgccaataatattggttggcatccgtttcccctttaccgacaaggtaactgttcccttgtgaaatgttcacattatcatgatagccactgacgacagtcaggttggcaatttgttcaaagcgggtcagataggttttaaacgcatcttcaacggtatcaacactaagttgactctggctgacggattgcagcaattcatccatcatgtgggtctgaccgatacgcatggtcggatcgatatagttttcaggatagtaaaccagcgtggaaacacccgcccatgtgctgtagcgtttgttataacgatcccaatcctgataaaactggcctgtcatgacatcggtggcaggggtactctcacggccattcaatgcacggttgatatattgctggatactggcaatggcctcagccagccgtgtcgtttcgacctgtgcggagatttggttatctattagcaggtaaccatacagatcatttctatctatcacctcagccgcactatccacaacttcacggatgtaatattggcttaatgcggcactggcttcttcctctaagacttgtttcagaatatctgactgattactattcagtccagccgccagtatatctgccgattggctccatgtttcgtaagaaacttctgtagtattctgatctttcagatagtccaattggagaagagcattaattttattcgggctggttttcatcacattggccactgccagccattgcagaacactgtctatttctgaccagtctgcatacttatttttttctgcaacttggtgattaatattggcctgttcactggcggttgaaagcagcctctcatccatcctcatggcgctcgccagaatagtactatccaagttgttactttgcagagctgtcagtactgtgtctgtattgctagccagtgaattacaccatcccgcaaaacggctaagctgtctcaccgtctcagtatctttgcccagatgatcggtattgctggagtgaccgatgataactttagttgtcaccgccagattcagagcattttccgtgagttgcgtggctaaataaatcaatgccaactgccccagcacctgacaaaataccatgctgtccggcttaatcggatcttttacaggttcaatggatttccagaaggcggtgacatccatgccattgggtttgatcttgttgatccatatcaggatcgactcagccacaaatgccgaagaaagtttcagtgccgctgcaatgaagggtgccaaggtcttgataagttgaagtggatcgtctggtacggttttgttctgcattcccgcccgtagcgtctcgatcagattgttaatatcgggtgataaaactgtactgtaggttgtggtcgtcatcatatacagggtataaatgctgattttctgtgtctgtaaccactgggtgatactgtaaagatattcaatgacttcgattaacttttccgtactgattttgttaaaagactcttcagcatatggcgagagttttagcaggatagccaattcattgatagaaagttggtgaatgtaggcaagcattcgtacgcggtacagcgcagataaatccgtagcaaggttattgtcgatacctgatgtattttcttgatccagaatcttagatagcgtgaataattcactgtcattaactttcaacgcgtgcttgagcatttcacgccgttgattatattgttcataatctgcctgatctggatcaacttgaattttatccccacccaattggtaatagtttccattcaatggcgggttattaaaaataaggtcaaaatgagaaggctgatcattatagctgtgctgagatattgcggtattacataacaccagtgcatcattgaaactcaaataatacctattaatatagtaggttgtataaaatatctttttcagaattgtttcggttatttgttgttgggcattatctgaatccacagcagtttcaatttgttccagcgtgataccggtttttttgtaaaggcgaataactttattcaatttgaggaaaaagagttgaggtaataccgtttcaattgagaatgtcgcatccgtattaaaactacctccactgccagaggctgctctttcgaatttcagagtaaatttttttctatcagcatcactggggaaatcaacgatatctgaataagtcttattgagctccggcagccaatcaggtctgtcgaggatagtctgcccattcagcgaaattttggtggaaactgcactggaagccggagctttaaaattataccaatattttaatttgccatcttttgtgggaatagcttcgataaaattaacctgccagccataagtctcgcctttggtgcgagtaatcaggtaagtaacgaaagaatttttatcatcaaggtaagtcactatggcctgatcgctgatgaatgcgggttcatcatcgttttggcctgatccatagatacccattacagcacggagagtatctgcatcaatatcataatatttcatcaaatagttaggattagacagtgcagaaatcggcaagtcaccgaaatttttcttatacatgtcttgcgcattctcagccgtaatttcttccgtcaggattttatacagttctggtgaaatttgacttgatatccccaataggctgaccggggacaataaaccaatcacttttggcgactgactaacctgactgagctgaggatagagaatgtcatttgatagttcaagcgtggagagggtttgatcttggttttcctgcgacaacattatactttgcaaatcaaggcgacgcttatcaggatggtagatgggtgattctaggtgcagatgtctggattcccgatacagttctgtcaggtaagcggctggtgagaacatagaggcgacagagccggacaatacatacttatctgaccgtccgccaaatagcatatcgtaactttgccactgcgagagttgctgaatgccgagatgaacagctccccttaactgcggattggcgcgggataataaacgtgcttcaaaaatcctgttttctttttcggctttcttggcggccagatacagatgggggctttctccccaattcagtgtgtctttgacttctttcctgaacgctgaaaatgagatcggcataatatgagccaatgttatcggtttccgatggttttccctattaagcctaaaaaatatattttctgtattgtacataaaaatacctctatattctctgtaaaatgattgaaagatatatttttatgtcacgatgaattccaataaaagaacattaacatggcctatttatggataattttatgtaaaacgcctaaaaatcccctcatggattataatcccaagaaaacgtagtgaatgattataaattaacaaatagacaataattattagttcaataaattatatagaattttatgctatacatttcaataatctttaatacgctcttcaaaaacagtaacaatactatttaaacagatccttaattataaataattacctcaaaatcacactattttcatgttatatttttattacctaagagacatttaataaaacactccattaacatttgcaatatatttcattgaatcaacatgaatttaaattaataaaaattatttatccattttattaactgcaatggatgaattacaatatattaatggaatcagtaacttatatttttaaagaatcttttaccgcatttatatattctgttaggctttcgatttacgcggtatgaccattattcatttttttatgtgtgctattttgatgaacttcacacattagataactattctcaatatcgctacattttatttactccatgctttcctccagaaactggaaatgcttcaacaaactactaaataaaacagaacctttactgccaccaccgacatggctgactttccctgctccactgtgaaggatgtcagcaagtaaccatcggtgaacaataaaggtagggtagctaagagcaaaatccccaaaaattacccgacagatacttttctaaaagctcctgatcaggatgattattaattaaaacggctttaacaaaaaaagatgtctatttttcaagcaaataatatgtctttttataatattctgctttataaaaggaagtgaaaataatgtaatacgtttgttattatttaaatggcatcccgcagggctaagcttttcttagtacgcaggaacagatgacacaaaacaaacgcactctgccgttaaggcaattctgagtttttcagcgccacaggggcaacaatacaccctgccaaagggaaatctccacagtggcagagtcctgggcgctgaaaagtgaggttgctagttttgaatcctcttggtctcacattactttcatttaaggaagcaatatgaacttgaacgatacctctgtttccgacttgcgggcgggtgattcggaaagcagcgccgacgtccaactggctccgagcaaagacaaagatctgcgcagccgcctgccacgtgaatattttgtcaaacgtccagccctattcatcagcaagattgtcttcgcctttgcgctaatcgccctaggatggtatggcgtcggatatgcgctgaacactccggtcaccatcggttccattctggtggccatcggcggcatgctgctcagtggcttgatctacccccacctggttgaactacagcacgaatgcctgcacgaccacgctttcaagtcggccaaactcaaccgtctgttcggcgtgctggtcgggctattcatgttcaactcccattcgcactaccgttacgaccatctgcgccaccacgcctatctcggtactgagcaaaatgtggagcacttcgactaccgcttcaacgatctggcttcgccaaaaggctttgctatcgcattctttgatctcaaccgctatcgccgtgtgttcaatatcctcggtgctgcctacaccggtaaatcgatctccggggtgaacaaggaacaagctcaacgcgatatcaaacaggaatatgtgttctatatgctgatgttcatcttgagtgtggtggcatcggtgtacttccaaacctggctatttgctttggcttggtggctaccgacgctggtgatcgccgaaggcgcacactttatgatcgaaatgccggaacactacgggctggacactcagagctcaccagacgtactgaaaaacacccgtactatcagcactaactggctcatcgcatggtacgtgaacggtaatcacacccacaccgcacatcatttccaccagggtgtgccgatgtgccatgtgaaaaaactcaatgaactgatcaaaccgcaactgcaagtggtagaaacctcctatttcgccttctatcgcaatgtgatcagtgggcgcatccgctcctacgtggatgtgagctgtaaagtcacggattaagttagcattgttaggcagaagtgttaggcggaaattggcattatcatcacgacacaaaggccgtttacccagcgctgaaaactatcgactgctatcggctggcagggctactggaaaacgccgcctccgtgctgcgcataaacaagtagtcctgcattaaagccgctgataaggaaaaaacatgataagaatattaagatgagaagataaaagcaggtagtttcttccccatttgattaggggctgttgacgttttgtattcatcatttattcagcccacattggcaaccagacaataataaacgccagtgccagcatgctggcgtaattccgttcaagtttgtcgtatcttgttgctatcgcacgaaaatgtttgattctggcaaaggcattctccaccaaatgtcggtaacgatataaacatttgtcaattttttgatccaattttcggctatttttgcgataagggatcaccggaaccgacttttgttcttcgataacacttctcaaacgctgactatcatatcccttatcagcaatcacaaaatctgataaaggtgactgagatacaagactttccgcatgaacaatatcattgacctgaccccagacagttcgaaatgaacaggtaaaccgtaactgtctacagccaaatggattttggttcaacgtcctccacgactttgacccattgcctcatcctcttcagacgccgctcctgcactatgctgatgggctcgaacaatacttccatcaatgaacaaccattctgtatcagagagtccagataaccagttgaaaattaaatgcaaaatacccttttttgaccaggcattaaaacgctgaaagacactattccctttcccgaattcggaaggcaggtcgcgccacggaatgcctgttctcatacgataaagaatgccttcaaatgtttggcgatgttttgttttgtggtaaataagtccagtatgttgcatgaatgcagatagcttatcccattgtgtatctgttaacatagttcgcggcatgagggtgaagtctagttattttttggcgaaaacgattatacccaatcatcatgctgttcaaattcccctcacaaaacgtcaacagcccctaggcatagctttattctttaacgtcttcgatagtctactaaagacaattatcgctgtctattcatccagtcttatagggttcgatatgtgactttacacaaaactatttccggcgtttcttagcaaaatcatacggtgttataggcttttctctgttcgcgtctaagtaatcagcccaccactgaaccattagccgccgttcgtccaaatgtttagccctaacgttttttctttctatgtggcttaactgacgctctatcgcatcatcgttccacaatgcagattcacccatcgcaccccgcgccattgttctaaacccatgtccacagacttctgttttggtgtcataacccataacacgcaaggcattattgactgtactttcactcatgacttttttggggtcatgatcgttagggaacatcacttcacaatcgccactcaacccacgcaaggtttcgataagagacacagcctgacgacacaatggcacaatgtgctcagttttcatcttcatgccacgttcagaaaatttaacaccttcgatgggcttccttgttgcggggatcttccagatagccctttcaagatcgacttcttcccaacgggcaaatctcaactcactggaacggacaaacgtaagtaaagttaactccaaagcgatacgggtaattaaacgcccacgatagcgagcaagacgggtcaaaaattcgggtaaacgttcatggggtaatgcgggatgatgtttggattttactgtggtgagagcaccagatatatcattggcaggactggattcaagaatgtcgttctggacggcataacgcatgatggcagtcacacgttgctgtaaccgccgggctatatcatgcttggtttctgcatcaactgctttgattggcgctaataggtggcttgttcttaaaatggaaatatcaagcctgccaatatgagggaaaatgtattgctcaagactgcgcaaaatccggttgctgtggtcttcactccaccgtttattactggcatgccattcacgggcaacccgttcaaaggaatatgctcctgccgacttaggtagcccccttttttctctatcttggggtcaattccttgcgcaagtaatttcttggcttcatctcgcttggttcgggcgtcagccaaagacaccgccggatagacaccaaaagccagtcggtcttcctttttgtctgttgggcggcgatatttcatacgccagtatttagccgcgtgaagtgacctccagatataacccaccatcatcggcaagtttataggttttatccttggattttgcagtctcgattagtcacgcatttagcttcatattgggggcgcatttaaaatagaagttaagatgccccttattatgcccctagggcgtgttgacgttttgtgaaggtaatctgaacagcatgatgatttggtataatcaatttcgccaaaaactcattaagcctcatcatcatgctacgaactatgttaacagatctcgtctgggataagctatttgcactaatgcaacacactgggctcgtttatcataaagccggacatcgtcttattcttgaggggatcctttatcggatgagaacaggtatcccatggcgtgacctgccgttggaatttggtcgatggaatacggtctttgtgcgttttaatgcgtggtcaaaaaagggcgttttaaatctgatattcaaagggttatctggacttgctgatagggaatggctatttattgatggcagtattgttcgagcgcatcaacacagtgccggggcagcaacaaatgaagaggaagcgataggcaaaagccgtggtggacgttcaacgaaacttcatttggccgtagacagtcagggtttacccgtccactttgaactgtcaggggggcaaacgcacgacattaagcatgcggaaagtctggtgaataactccccggcatcagattttgtgattgcagataaaggctatgatagtgacgctttcagaaatatcgtcgaacaaacaggggcaacacccgtcattccttatcgaaaaaacagccgaaaatcagaaaagcccatagacaaagggttatatcgttaccgacatttagtggagaatgcctttgccagaataaaacattttcgggctatagcaacgagatacgataaattagaacgaaattatgccagtatgttagcactggcatttactctcgtttggctaccaatgtgggctgattgatttatgaccataaaacatcaacagtccctaatacaccgaggggtaattggttgaagacagaagtttgggccagccagcagacccgcccaaacctgatcaaacaataaatgtgctattcgttataaagtcccgtcattcgttatcaaaaacctaaactatccaataaatcatcaacctgcgcttggttggcaataacaccagctccattctgattaacctgagggccgttaagaaggctgtcgttctcttttttcgctttggccatctggtcagaaggcatattttccattaacaccatgaccaattgtttttccagttcctgaatgacttccatcatccgtttgatgacctgccccgtcagatcctgaaagtcttgtgccatcatgatctcaagcaattgagtattggtaaatgagacatgttcaggtacgagattgagataatctctggtatctgtcaccagtgagcgagcctctgtcagttccagattgttcgggtttgcaaaccactcatcccagcgctgggtcaaggatttcgccgaagattccaattcattctggtggggctgtgcctcttcaacgcagttcagcaccctttcagccgcctgtgccgtcatctggacaacgtaattcaaccgctcccgcgcatcagggatcgcctcagccgcctgagcaatggtttgatctaaccccagttcacgcagactatcgcgcagcattctcgttaactgcccaatacgactgattatttcactggtagtaaccgcctcatctctcggcatgactggattttcactcattttgtctccttagagccctaatttttcaaatattttattgagtttctcttccaaaatcgccgcagtaaacggtttaacgacgtaaccactggctccggcctgcgctgctgcaataatgttttctttctttgcctctgccgttaccatcaggacaggtaaggcagccagcttttcttcactgcgaattattttcagcaattcgagaccatcaatattgggcatattccagtcagaaataacaaaatcaaattcagcagcacgaagcttagccagtgcttcggctccatcctgggcttcatcaacgttgttgaagcccagttccttcaataaattgcgtacaatgcgacgcatagttgcaaagtcatcgacgaccagaaatctcagatccttacttgccataaaaactccttggaatttcattcatccggcagcacagtgccgcaaaagttaacatcaaataacaacaactaaatacgaatcgattgccctgcgctgattttggccagcatcgttttactgattttttgaatatccataacgtcatcaatagctcccagctggatcgccgctcgtggcataccaaaaactacgcagcttgcttcactctgtgccagcgtataagcacccgcctgtttcatttccagcaggccggctgcaccatcactgcccattccggtcaagatgacaccaacggcattgcgtcccgcatgtttggcaacggagcggaacagcacatcaacggaaggacgatgacgattgaccggcggggcccgggtagtcatgatttgataattggctccgctacggcacagttccatgtggtgatcccccggtgcgatgtaagcatgccccggcagaacccgctcaccattctccgcctctttaacggtgatttggcttaatttattgagcctttctgcaaatgaacgtgtaaaacccggcggcatatgctgggtgatcagtaacgccgggctggtgacaggcaaaggttgcaacaagttttttattgcctctgttccccctgtcgaagcgccgactgcgatcagtttttcgctggataatagtggcttgaaattcaatggggtggcaatcacaggactggacggcatggtactgatttttgcctgcgccgcagcgcggattttttcggcaatcagctcactataggccagcattccttcgcgaaggcccagttgcggcttggttacaaaatcgaccgcccccaactccagtgctttcaatgtaatttctgatcctttcgccgtcagagacgaaaccatcacaaccggcatgggacgcaaacgcattaatttttcaagaaaatcaatgccgtccatgcgtggcatctcaacatctaatgttaatacctgagggttgtgtttttttattaaatcacgggcaacaaacggatctggcgcgcagtccaccacctccatatctgggtggctattgattatttcccgcatgatctggcgcatcagcgccgaatcatccacacacagtacagttattttattcatgacccctccctgcccgacgacctacaccgtaaacggtctgtccttgcaagtagaactctcggctgatttgagtgacgttttcggaatgccccgcaaagagcaaaccatccggttttaagaaattgacaaaacgacgcaaaattctttcctgcgtctttttgtcaaaataaatcatgacattacgacagaatatcgcatcaaacttaccttcgagcgtccagtcagaatccaatagattcaagtgctgaaagctaaccagctcagccagtgcgggacgcactctggcatatccttcaaagaggccaatgcctttgaaaaaatactttttcttttggctatcactcatgtgctgtaattcttccagtcgatatactccctgacgggctttttccagcacatgagtatcaatatcgctgccaatgatttttatccgatttgtccgatgccccaatgcatcacacaaggtcatggcgatagaatacggttcctcccccgtcgaagcggctgcgctccaaacgcggtatgtgcctccgttttttctgctggcatgcgccgccaaaatgggaaaatgatgagcttccctgaaaaacgccgtgagattggtggtcaatgcattgatgaataattcccattctttgctatgaatattctgttccagaatcgacaggtattgaccaaaatcattgattcccagtacacgcaagcgcctgaccagacggttgtaaaccatttcacgtttatttttggccagtacaataccagcccgttgatagataaactggcagatgcgctcaaattgcgcatccgacaaaatatgccgctgaaacataaagttcagcggtgaaatagcatcagtatctgaggctgctaaattggatttcatctgacctcagcgtatttgacttgcgatatactcatcggtcatttttgaagcagagggtgtctgatggtcatactcattgtctaagccttcaggcagttcaaataaagcaacggttttcactaatgtgtctgccttatcttcaagcgcagcagcggctgccgcagattgttccaccaatgccgcattttgctgtgtgacttgatccatctggctgacagcttgggcaacctgatgaataccacggctttgttcatcagaagcggcggcaatttcagccatcagttcagtgacttggtttactgatttgactaattcatccatggtgttcccggcgttattaactagctcagaaccttggttaactcgatggacagattcatcgatcagggttttgatttctttcgccgcctcagcactgcgttgcgccaagtcacgtacttcgcccgccacgacagagaacccacgtccctgctcaccggcacgcgctgcttcaaccgccgcatttaatgccaggatattggtttggaaggcaatgccatcaatgacactgataatagcgctgattttcttcgaactgttggcaatttcatccatagtggccaccacgctgacggtcaattcaccgcctttcgaagccgtctgggaagcggatactgccagttcactggcctgacgtgcgttttcagcgttctgtttaacagtaacagtcagctcttccatgctggcagcggtttcttccagcgacgcagcctgttcttcagtgcgtgatgacaggtcggtattgccctgtgtaatttcctgaataccggcatacatctggttggtgttgtctcgtacagaggcaatcgacttgatcaaagatttctgcatatcgcgcagttttctgaagatatcgccaatctcatcactggtcgtgacagcaatttctttattcaggcggccttctgccacgtcctggaaacaggctcgcatattgtcaaacggccggagcagattacgtcgcatccaccagtgcgctgatgccgaaacaacaaataccatcaggatagaaccgaaaaacatggcgatggaaactttatagtaaaaggcaccatcggaaaccgctgtgctgatgttatggccgagatactgcatgtaattgttgtatgcgacttctagctggcgctggtaattttctgttggctgatcaagaaatgcctggaaattcccttcataaagatacgttttcagctctttcaacgcattaatatattcttggtaagaacgttcaaccgcagccaataaggcgacactttggtcattcttttctatctgaggtaaggcactgaactgtgcgaaattcctttcagcttcattcaatgagcttttgagcaacgcttccatcgcgtcgatctgatcctgcgactgacccactttttggccaatggcaattttgttgagagtgttacgcgtttgcagcattgctgcccagctcaatccaagggtatctcttcgtttagttcccaaatcaattctttcaatatatgactggtctgtatgaattattcccagggacaaaccgctcgaaataatttgcataacacaaaacatcatgagtaatagatacaaactggttgatatgcgaagcctacctaacatgtaatcacctcgtttaacggctgcattatgcagccgtggttatcgctattattttttagaatgtttcccaattagaggggtcttccacattactgcctttcttcagcataggaggattcgttttattagctggaggagtcggcgattttatcgtcgataaaacttcatgttttcttttttcagactgcttcctttcggcctgctccggtagctggaacaacgcaactgctttggtcaagatcatggcctgctcttccagtgccgctgctgcggccgcagactgttcaaccagtgacgcattctgttgtgtaactctatccatttcagaaatagcgacaccaacttgagtaattcctctactttgttcatcagaagccgatgcaatttcccccatgatgtcagtcacgcgggtcacagaatcgacaattttgttcatcgtttcgccggcactttccaccagcacagagccggtgtcagtacgatccacagagtcttcaatcagggatttgatttctttggccgcttccgcactgcgttgtgccaaattgcgaacttcgccggcaaccaccgcaaaaccgcggccatgctcacctgcacgagcagcttctaccgcagcgttaagggcaagaatattggtctggaaggcaatggcatcaatcacaccggtgatatcagaaattttgcgggaactgtcagcaatgtcatgcatggtttgcaccacattcgccaccactttacctccctgacgggcgatatcggaggcattgtcagccaaattgctcgcttgacgggcattgtcagcattctgttttaccgttgcagtcaactgttccatgctggcagcggtttcctccagcgaagccacctgctgttctgtacgagaagagagatcgttgttacccgcagcaatttcgctggtgccggtatagatggtttccgtactctgatgaacacttctgacggtatggatcagctcgtcctgcatatgcctcaagccaaccgccagcatgcccatttcattggtaccggacacattgatagtttgggtcaagtcacctttcgagaaggctttaatattttccagtaacttattcaatggattgatcaatgctttacgcaagctaatccagcttactgccataaccaaaatcaacagcacaaacacagagattaagctaatgatgatattgcgataagcgatatctgcttcgcgcgccacttcatcatacagtttttgatcctggttcagatagtagtcgtattccacattaaaagcgttctgatagtcggtggttttctgggcaaaaaattctttatactgtttttttgccagaaatccatccaactctttgagcgcgttaagatattcatgatgagtttgttttaaacgttggagatggtctggatcatgtatgggcaattttttgagctgttcaaattgctcgaagcggcgttccccacgagctagattgactttagattcagccagaacatcatcaatttggtaagtaccatcaagatcgcgttctttcatcatatagatgatgccaacgcggttcaggttattacgggcttgcagcaggttgatccagctttcatccaataacttttgctgctgccgcattttatccaataaatcaaaggcttctgtatcgttctttaaaccattaaagaacagtcccccggagataaattgcagagcaccaaataatatgatgactgagattagccccgtcactattttcattcggttaaacatgacttcccttttgtaataaattgctatgccagtgttatcggcacccttaaagggaactttatgtgtaatccaaaaaattgagtttttgcactatttttttgatctaaaacaattaaggctgccgttttgctcgactgactataatgagtggcaacaatcacgacagccctgaaatatcagctcttggcgacagaatccactaatgccatttcttcactgttaaggagtttttcgatatctaccagaatcagcatccgctcatcaatggaacctagccctgtcagatattcagttgacaaggtaaccgcaaactccggcgccgggcaaatttgatcgtccttcagagacagcacatcggacacgccatcaaccacaatccccaccacacgattaagcaggttcaggacgatcacgacggtgttgtcgttataagtgatgttttcctgagagaatttgatcctcaagtcaataatgggaacaatcactccacgcagattggttatccctttgataaaagaaggtgtattcgcaatccgggtaacttggtcgtaaccacgtatttcctgcactttcagtatttcaattccatactcttcgtcacccaaggtgaaaaccagatattcctttccggtcgtttcccccgataatttactgaattcttctatggctgacatgatgttaccttttactgtgttatttttttattcaccagctccgccttacgcgtagccaactgttcatgattgagtttctgcaaagcaggaatatcaatgatcagggcaacactaccgtctcccataatggtggcagccgaaatgccaggtactttacggtaattgctctcgatatttttaacgactacctgatgctgcccgaccaatttatccaccagcagtgcatagcggcgccccgcgctctgaacaatgacggcaatacctttggttggcgaggtttccccgttcgaaatatcaaatatccggtacaattccagtagcggtaaatattctccacggacttgcagcagtttttcatcgcccgccagaggatagatatcttcttcctgtggctgtaatgaactgaccacagcactcaatggcagaatgaagacttcgctattgactttgacggacatgccatccagtattgccaatgtcagcggcaataaaatgcgaatgatcgtccctttcccttcttggaaactgatctgaatctggccacccatatcctgaatattgcgcttaacaacatccattccgacgccacgaccagaaacatccgttaccacttctgcggtagagaatcctggcgcaaaaatcaacatagcaacttcttcattactcatgttttcactgatattcaggccttgagaccgcgcttttgccaagatcttctcgcggttcaggcctgcaccatcatcgataacttcaatgcagatgttgccgccctgatgttcagccgagagtgtcaagttacccgtttctgattttccggctgcaatccgtttttccgggttttcaataccgtgatcgaggctgttgcgtactagatgcgtgaggggatcaataatccgctcgatcaagctcttatcgagttccgttgagctgccgatcagcgtcagctccacttttttgttcagtttacctgccaaatcccgcaccagacgtggatatcggctgaaaacgtactccatcggcatcatacggatcgacatgacggattcttgcaaatcacgggagtttcgctgcaattgagccatacaactcagcagttcgctgtgttttgtctgctccaatccatcacaatgctgtgccagcatagattgggtaatgaccagttctcccaccagattgatgagttgatccaccttctcaacagcaacacgaatactggaagattcgacacgttgacgtggtgatcccgctaccggacgcggggccggacgccctacttcatgtacttctgatttttgtggcacatcagcagactgtggtttatcagtacttatcgtacttacagccacacgactttcgattgccacaccttctgccgctggttttttttcagactgagtgtctgcttcagtttctgccggatgcgagtccgcaacaggcagaaaagttatctgttcagtttcaatcacaaaacacattacagcggtgatgtcatcttctgttgcagatgtgatcaatgaagcttcaaggctgtctgcggtctgttcaacgtcgtaaacatcaccaagatgccccaattcatccttcatcaaggagacttcgcgttcttttagcccagatagatgaacgcggattctcccttgatcagttttacctgccggaagatttttttcttctggctgattgatcacgactgcttgttcttcttcagcttccagcacagtctctttcaatgcaggttcaggctgaattgccggtgcggcagtgtcagcactctcatcctgcttatcttcctgtagctctaaggcaagctgacgcaatgtctcgcagatataattgaatgtatcttcatccggctcctgagaacttttataggcatccaattgttgctgcataatatctttcgcttctaaaaacaggttgataatgtcagtagtcaggcgtatttcgtcacgtctggcactgtctagcagattctccaaaacatgcgtggtttgttgcagcttggcaaaaccaaaagttgcagcgccccccttgatggagtgggcgctacgaaaaattgcatttagttgttcatgatcaggttcatcggcatcgagcagcaataaatgctgctccatatcgtccaataattcatctgcttcatcaaagaaggtctgataaaacgcggtaatatccatcgttacttactctgtcaccttattagtatcactggacggttcagtctgagtctgcaccgatattgtgatttcactggattgttcggtgggttgctgagaaggcgctcccttattcgaatccgttctgatgacttcttgcatatccatactactgttagcggtcatggcgtcaccaccactgttttcctgctcaatccgtttttctgcatctttattcaagacaataatgctgatacggcggttaaccggtgcattaggatcaattcccttctgcatactgacagtggatgccataccaacaacccgcaagattttgacctcatccaagccaccgttcagcaattctcgccttgaggcattagcacgatccgtagagagttcccagttgctataacccctttggccattggcatactgtaaattatcggtatgaccagaaaggctgactttgttcggaattccattcaaaatcggtgcaattgcctgcaaaatatctctcatgtagctctcaaccttcgcactaccaaccataaacatcggacggttttccctatcgatgatctgaatgcgcaaaccttcatccatcatgtcgatcaacaaatggggacgtagttcttttaggcgaggatcggtgataataagttgatcaagttgttggtgcagtcgattcagacgacgtttttcctcattggattcaacaagtttagattcgcgaaaaacttctccatcctgctgaaaaacttcatcccctcccccaggaatcggatttgtgctatcgctgctttgtggcccttggtttatcgctacctgcaagggagtgcgaaaatagtctgcaatgctggttaactcctgtgggctggcgatcgatagcagccacatgaccagaaaaaacgccatcatcgcagtcatgaaatcggcatatgcaatcttccatgatccaccacagtgcttctcaccgtgttttttgcgtttttttactctgatgacagtaacattattcgctctcataattattcttcgacttcttgttgtacaggagatttaacccgacgaacatgttcttcaagttccgtaaatgaaggacgatctgtgaggaataatgttttacgaccgaattcaaccgcaatctgcggagcataaccattcaggctggaaagcagtgtaatcttgatgcactgcatcatttttacctgttcgctgctacgttgacgcagcaaggttgccagaggagaaacaaaaccgtaagccaataaaatccctaagaatgttcctaccatcgcatgggcgattaacgcacccagctcccctgccggacgatccgctgatccgagtgcatgaaccactcccatgacggcggcaacgatgccaaatgccggcagtgaatctccaaccatcgccagactggtcgcagggacttcactttcctgttcataagtctcgatttcttcatccatcagggcctcaatttcatggggattcatgttaccgctgatgatcagacgcatataatcagtgatgaaatccatcaaatagggatcttttaacaaacggggatactgtgtgaagatgtcgctctggtgtggattttcgatatcccgctccaaagccagaagcccattttggcgtgatttggataacaggcggaacagcagcgccatgagatccatgtacattgctttgttgtattttgatctgcgcaatacttttggtaaaacacgcagtgttgcctttatcgccttgccattattgcctacgataaaagcgccaatacccgcacctgcaataatcaaaaattccgctggctgataaagtgcgcccatgtggccaccgacaagcagatagccaccaattaccgcaccaaaaaccactacatatcctaaaagtactaacacgcgatatcctttagctaagttggtgagcagatgggatttgaacagggcgaattagtaaacgaagaacggtatgacagagcagattacaggtctgcacataaaaacctgtaacctgcttttaagtttcccatttaaattcacatagcttgctgagcaaatccatccagcagttgtgaattagtatcggcaggcagagcggaaagtttacgtttttttaccgctcgtgaaggtggctggcaaagactacaaacaaagctgttcaccggttggtgggcgtgcgtgatgaaagtgccaccacagcagcgacactctgttggctgtagcatcccgctatcaacgaaacggacaagtgtccaggctctggtcagtgccagaacaggcccaccttcgctgcttggaggacattgctcaaggtacagtcggtaagcttttacaacagcttcaacaccgtcacaatgcccgcttttcatcaagaaacgataagcattgtagaacatagaagagtgaatattctgttcccaagtcataaaccaatccgtcgaaaaaggaagcatccctttaggcggagggcttccccgcaactctttatacagcctgatcaatcgccctctgcttaattgtgtttcactttcaagcatttgcaaccgtgcacctaaagtgatgagctccattgcaagatgaatatctttcgcttcctgaacaatacttttttcaaccatcttcacgctcttttcttgattgaaatgtcatccagcgcagataactgctgaaaaagatgagtagacagcaagatacctgtgtgaatttgttgcaaatcgtccacccgcgattccttcgttaactgcagcaccgtttcgtggtcttctaaccgaaaatggcaaatcagttggttagtttcagctaattttactaactgaggcaatgtcagctcggccaacgtatcagccatcgattcactaatacctaaacggaacatcgcagatgctttctcatggttaattagccgttgcgctaaaagcaaatacgataaatttatgtcataaatatgtttgagcaattcaaccgtactcatttctatatatcccgtccgattatatgaaaaattaattaagtgatcaaagaatcactcacgacaaaattaccagtagcatgagattcaataatctccgacataactgaaatatacatctttagccagagcagtaactgtcctttgtattactcttgggatcgcccaatttctaaaatatttcggtaatgggttgtgaaagtattattgcgtcatctgattaatgcacttgccacaattgattaagaatattcttaatgctaattaactttactcctgaatcatcaacttatacaacggagaatatatgccattttaaatactatgtgacatatatcacaaaactgacactttttattatgattctagctcattaactattcaagcaatagaaaacgaaaaatagtccacaattaataagttaaattatctaaataaaaatattaaggactgttttttggtttatacgatctattaaacttctaaatttaaaatggcgataaaaaatatatactttagttaaattctcaaaatgtttagaaaatttgcctcttgataatggaggtagggacctctcttccactataagttgacttaaatataggtatgcccaaatttattaattatatgtgaatactagttattaaaaagctactaatctgatcatttttggtttacgatcgtattcttttacacagaggaaaaggtggcattcaagccactttacgcataaatatcacacagatcacaaaaataagataaaatacagtatgatgttgaaataaaaaacatctacatccctgccttagagtaaataaagcggacaaggcttcgagaacacaacaaaagccactactattcaaaaccacagaagtcacgctagaccaccattatatataaaattatctaaagtaaataaacttatagatagacagtttatggcataaatttaactaaatcctcactggttgttatttctcctcattgactaccttatacccacaatcaataagataaatttatcattaaaagcgtgctcttttttcataatgttaagaataatcaatgtttatgccatttatacagaacggagtgactgactgtgtacgcaaaagaaaaatcccccattaacagaaaattaatttccttaaataacataaaaaatagaaacaaaatcactcccaaatacaaatttaacaataaattcttataacataaaatccaattaaaagaagaaaaaacactttgaatacgaaacagggaatgcaaacagaataaataaatatgaaaaaggaaattatcttacttaatttaaaatataagtaacaatagatcatataaaagtaacgattcaaataaaaagaataacgggtaaatatgaccttattacctcattaaatttatatttattgtgatagtaagatcatattcaaagaataacatcaatacctattcgaaatatctgtaaaaaatgagtcatgataagggtgataatggcagccgctgtgtggacggctaccttaatccacacagaataagatgttaattaatgagaattatttacaactatccaccaacgtgatgaatgtaaaattgcttcatcatttgggtgatgacgcagtcgcatattagtgttcctattcaccaaagaaaatatttctaaagcaatgactgtaatccaattagtacatcaaatggtaaaaatggtatgtatatacctagtgtcataattattgacgttgttaataacacaggtaatacggcgatactttggacaaacagaactttttgtgtacgcaacatatgtacagccagtgcctgagacaactggccttccatgaactagcctattggaatgaagtttgatgttctgcacagctcactataaatatatatcaaatcatagcgaatattgtgatatctaagatagaaaatgtcgtccctaacccaatcataaaatatccgatattctttacatctatttgcgagggattctcaataactctttatccattttgtcttacgacaaagacagttgtgaaatatcgtacattaggttttgtacaagcaaatagatggctaacatcagtaaaaatggaataaatactctggaaatcagtatcgaaaatacattcacgaaatccaactggctgtcatatttaaatacttaatgatattcccaaacgtttccctactttttattactcgttcccctaataccatcaaatttttatcaaacaaaatgatatcctctgactcttttgcggtattggttctggtgtcaacagaaataccgatatcagcataccgcaatgtagacatatcatttattccattaccgaaaaaactaactgtgtatttactattttgcaatgactttaaaatgcgtgacttttccgtggggttaacttacaaaatgctgttcttaattccacttcttttgaaaggtcttcatcactcgcaaattcaatatcaaaattaataaaaatattcctaggatctaaacccacatcacggtaaatttctgcggtaatgacagggctatctccgttaagcaccttagctgaaacgtcattttctcttaatgcagccattgccatcgccacactcacctttggcaaatctaaaaatgttaataaaccttgcagtaccctctccttttcatcagcaacagaaaatggatgtttcacttcatcaagacttaactcccctgtcactaagattaaccctctgaaaccttgctctttatagaggttaaccagccccatcacattgttacgattttcttcagtgagagaaattattttctcctttaacctcatatgagagcatactgatgacatttccacagtagcccctttaccaatcaattagcacttttgctactgtttttgaacagaaattggcaagctacgtctaacaaaatcaaaagataactcatcaatttttctgtagctggtgagaaaaccaataccaatttttcgctcccatacctgacaatcgcttgatccatcaaatccatagtgccgcttgtttagctatgcccaatggaatactgaagtctcttacctgccagaacaagaataaaccactaaatgaaattattattaagataataataatattggttatatttatttcattttcatggcgtgacgacaaaaagtaatcagtaaaaaagatgatcatcgccaaaagcatcaggacttaaataaacgaattatggaaagtgatggattagctgaataaacgcatgaggtgctttttcatgtgtacttcattgaataggttggctggctttagacaacgccttattcagttcaagggataggcggaatatcatccgtccttatcccctgataaatataatattatggaattagtaatataaaattattctaagcaggtaattctgtagcaattttccaattaactgaactgacgcttttttccaaactcactcgacaaacaatcgactctatttctttttgctcagtcggtgttgccaatatttctgcacagacttcaagcctgtcgggttgagtggcattagcatcagcactactcaatgactgcaatctgacacctaacccattaatagcctgtaggatcagtgtcctgactaggatttcatcatgaatatcacaaacaatatggatcttatagcgttgttctaaatctaaggcttgttgataaggttgggtattaatccgctgtgcggcctctctcaacagaatgttcgcacacagaataatgcctgtggcaatgctcgcagaccaatattgaccaagtccgcataacacgccaatacccgccgaacaccacaatgttgcagcagtatttaagcctcgaatattcattccttggcgcataatcacgccagccccaagaaaaccaataccgaatacaatttgcgcggcaatacgctgacgccattggcgctcagctccaatcagagccccaaaaaacattgcagatagtaaatgaatggcaataggtgttaacaacatgaaattctccataatatcaaatggataaatcaagaatcatgtgcattaatggcctaattcagttaagtaatcaagaaaaattaattgcaaatttagcaccataaccttccaatagagtatttagctcatactccacggtatcctgagtccaagtgataaagcgtcgccagtgatatttggcttgtttccagatgatttcaatcagattcagctctgggctgtagatggtgtcgtcataagacatttaaccaaagagcaagacagcggatctgaacagtagcaagaaatgaggcactatttttggcataacgggtcgctataccccgccagcgtttaagatgaagaaaagcattttcaactaaatgcctgagtcgatagagttcccgatcatattctcgtttcactttgcgattttttcggccgggaatttgcgctgccatgccttgtttttctgcttgttcaacaacggtattactgtcatagccccgatccgctaataaatgttctgcatctattccgtcaatcaaggcctcagcttgtgagcaatccgctgtgggaccgcttgtaataagcgctctgatcggcataccatgcgcatccacggccagatgtatctttgtattgagcccccttttgtgcgccccatatcctgattgcctcctgccgcccctgcggcgtggggatgaaccttaatatgactggcgtcaatcatcagccattcgaaatcgggttcaaagatgagttcttcaagcagttcttcccatacgcctttgtcccgccaccgacaaaaacggcgatgcgtatttttccagtcgccataatcgggcggtaaatctcgccagggtgcgcctgtccgtaaaatccagaatacggcattaataaataatcgattatcataagcaacacgcccccaggctcccttacgtcccggcaggtgaggttcaagcaaactccaaatatgatcggaaatatcgtgacggcggtgtacgggtgtgctcatggttaagtcatccattcatgtaatatagggttattattacatgaatttatttatgacgacaccatctaggcaggaagataaaataaaagcaggttgtgttctcgtaaccagcgatttctgatttttttctctatcccatgatggatacgcgcattatccaacactaaaaatgtcaggcggttgtccccttgtttggcgacctgctctaaaaaatcaatcacatcagctcgtgtgatactgcctgacggtgcctggtaaaacagcgtgttgtccgtgtaatttaacgcccccagaactgaccgtctgtcatggtgttgaggctcagtttcatggggtttaccccgtggactccatccatattgcaccggcggagaggcggcaaaaccggcttcatcaaaatagaccagacggtagcggcctgcccgtgcaccggccttaatcttatccagcaagacggattttttagcgaactccgtttcatcgcgttttttttaacgacagacgggctcgtttataggtgagcccctgttttttcagtgtctttgccagcgtttcaagcgtgcatggcaaaggaccgtgcttttcctcaacccccagagctattcgggccagcgtcagggattcggaacaggcgatttcaaccgcggttgcgatcatttcaggcgtcatggcgagataccggccgccggcatgaccgcccaatagaccggcaatcccgaagtcatgccaagtgtgaacccagttataaataacccggacactgcatcctgtctcaacggcgatctggcgcggttttaatcctctggccagcatgagtaaaccggttcctctcgtacggatgtcccgatgctgatgattcagggcgagttgttgcaacgtgattcgttcaggctcagaaaggactatcttcgatttcattagtggacgcggtaagtcagtgtattgtattaccgactataacaaaagtgcagataatttcattgattaacttagttttatttattgaggttctattgactaaataacttaagatgattttcaacccgtagttgaaaaataactcccatacgttatatatgaaaattttagccactaataactattttttaatagactacagctcaatagataacctaaagagataatttcttcatcttacacatggaatatgatgccgaatatttaattcgactagattatttgtatgttcccagaggaaataaggagtgagtatataaccacattatgaataccccgatatagtttctgttgatactttattaagaattcaatgcaatagattctgagtatcaaataatcttttgtcgggtgagtacagctcatgaaattggagtagtaccgcccaccttttaaggtaagcagcagatcgggaggaaatgaacagcttaccggattattttttatttaacctaagactttgactgtccaattgttagttctccaataaaattggtttggagtataaacaggtaaaattgataagtaaaggcttaaccggtagacgatttcacaaaaatcgtgctatttatcgcctttttcattaaaaaatcataggtcttaaatagcgtgtgactcatttttatctgagtctgggggataggtaacaaaccgtgttcttcatcatgttatttttctcatccaaataaattggcataaaagtaactaagataaaaaacaaaaagcccgccacggaatttaagtgtggcgagcttaaataaaggcataaaggcttattagatagcagttacgtttgctgctgctgggcctttggcaccattttcaatggtgaattctacgttctggccttcagccagagttttgaaaccgttaccttgaatggcagagaagtgaacgaatacgtctttgctaccatcagctggagtgatgaaaccaaagcctttagactcgttgaaccacttcacttgacctttcattttgtcagacatttgactttcctatatatcaaaaaaaactcgccacctcgggcatgtgttggccagtatcagctattacttatggaggcactaagaaggaaacggtcaacaaaggctaccagagatagcacttacacataactcattaactcaagatgtcgtacataaagtaggtctgtttatcaggccaaacgcattaactcatgaccgcacaggaatagcaacctttttatgtattatcgatttaaaaaagttgtatacgctcaatattagaacagaatgacataataaataggtacagttataattttatttgatttattcaacttttatcttagcaaaaatatcgatattgtttccagacaataacaattttataaataaaataaggcaattgatatacaggtgtgtgctccgggcatgctagccttaaaaatggcataaccttcaattcgataacgcgtttctacaataatcgggttagtattatgaacatcatcaaacagatattgattcaggatcttaagcggattaatctcgaagaacaccgtgatggtaaagtgcatttcaatagtatctttattcgtcatcatccatacctatgcttggggatggttactgcttatgctttccttgtcatgctcatgggatattctccctattttggcacttggtcactgattttatttacagtactttttgtcgccatggcagccgttctgcttttcgatataaaaccggtgtatcattttgaagacattgatgtactggatttacgtgtctgttacaacggagaatggttcgtcaacgaaaaagtatcccataaagccatcaataaaatacttactcatcctaaagtacccagtgaaatgaaagatgagatcaaacgaatcatgaggaaaaaagacggcatttgtttttatgatgtatttatagttgccttttcagaacaatcaccctattttcacccttccgaaatggtgaataaaagtgcgtaatttcagtaaggtagctcaatcatgacacaatacgttcacagggtaagcaaacgatagggaaatagaatttttgcgttgacactctcaaagttcatcgctagcattcgcctcgttctcaagaacgaagcaattcctccatagttcagtcggtagaacggcggactgttaatccgtatgtcactggttcgagcccagttggaggagccaaatttaagaaatcccgatttagttctgctaatcgggatttctgcttttgattttatcaatcagctaccctccttactcagatatactttcaatcgactgtattcgcacataattgaagttttttgtcggtccgctcgatatcaaagtgctcctttctcacgttggtagatttgttccttattctttacatcgatttgctgaatttttatcaaggtggtacccagaactgagcaaagaagtgataggaggttgagtaaggtatggaaaattgcagtaatgcttatattttgctgtaaaaaataacaaaatatcatcatgttgcacatcagttagacacttaaacttattttccatttttccgctttacaagcctgactcattcccctattattcgctccgctctcaggaacaaagcaattcctccnnnnnnnnnnnnnnnnnnnnnnnnnnnnnnnnnnnnn

SEQ ID NO: 16909 - DNA, 41356 bp, Xenorhabdus bovienii
  unsure (1)..(41356): unsure at all n locations
tattcgatattttctaccgttggccgttcgttaatgacttgagtggcattaaacggcgtggttagccgatagtttggatgtttatcaagaaccaacaataaaaaactgtattcacccggcatcagcgcattgaaattatactgcgtaaattcttctccactggtgtcttttatttgagctaactctgacggcgtgaaactcattatttgccctaattccgcctgaatgactcccttttgttgctgcaaaagttcagggggatcttccttcaacttagtggtaacttccatcttagagtgcattccggctaataccaataacaggttatattctccctgtttgagtttgatcccccgtttgctagcctgttcttttgatctccaagcggacacggtgtaacccatttgcgtcgccatttcctgtggcgtcaaacccaaagcacccctcagctgcctcacattttctgccgttggctgttcactaattacgcggctttccttaaactgcgtggttaaccgataatttggatgtttatctgcaatcaacaataaaaaattggactcacccagcgtcagcgtactggaatcatattgctgttttaactccttactgcaagcttcttttcgttgccaaggtcgcaaggtcattcccattatccggcctagttcttcctgaaaaagccccatcctttgccgtaagaagatgattgtctccggctgaaggatctggttaattaatctaatcctgtccattctgattgctccaaaaatctgaattcaggaatatcttaacttgacgtgtacgcggataattttgttcgcgcaaatcagcgcgtgttgttgcaacaaaatgagtctcaacgttaaccagattcaactttcgattccaacgtctagcgaccgccttataggaaccatcatccagctcgtaaacctcaaacgtatatttgttattaccgctaaaaccttcgtcgtaatacacctttttcatgtggtttcctcctgtctctttagaaaaccacactgattattgcgtttcatacattgtgccttcattgtaaaatcgtcatcctcgctaaccctaagtagggttcaatcatcatcagaaaacattttagcgctgtttgcccttgtttcagcctcatttgggtctgtctggactgtttcctcttttggctgcgtacccgttcccttatcgtcagtagaaacatcagctgacgttggtgataacgctaacgttctgcctgtcagctgactcgaaacattaatcagcgtgttggtatcgaattcattcatcgtcactagcaatatattactgataatacaatggatatcggccaatgttgtttgctcatcaagaaattccgcaatcaaaatggcaaacgttactcttgtagcggataggtaacgctacgtgaattctgaggcaaaaccagagggaaagtgttcaattttttaaaatactgacaattgagttatcgcattgataatattatggttcatcggctaattccttatttagcgtgttatataaataaattagaagctgttcccggctcatcgcttgcatgattgacaagtcagaacgcagtgaaagtacctgtgaagccagctggattattttcgacactcttctgtttactttctcataccccttatatgtccgtatgtgaatgcccagttcttctgctgtacgctcttgtgtccagccctgcgctttacgccataatctcaattcgtagcccgtcatttttactcacttttatttgctaccgcacaacaaaacacagtaccctgacggcaaggcactgtgtaatcttttttctaacccattactcgttaaactgaccgtcgtcgaatagcatcggccaatttttccgccgtcgctttttgggcactcacactggcaataatcgtagaacgatcattctctacacgagtgcaaattccgttccagttttttataaaaaagaattcttcgcgcttcgaagcatcaatttcaactgcgaatgaatcaatcatggccggaatttttttcaattccgtctcctgcgctaactgacgtacagcataaccaaaagcgttaaccataacagcatgaaattgaatatattctttacggtattgcacttgttctacaacacctttaatgtcattcagtgcactgaaattaacccaagaagaccacacagcatcaatttcttccgccgaggcgatctgttccccgttaaccgcaaattttcgggttgcatcgcataatgccttgaaactgacaaaatagtcactttttgatttcaccacattatgttcaaaatctgtagcgtcagaaagaacaggattctctttcaatatatcccgtaccatattggtaagtttatcccgcccattataagccatgctgatggttgcacttggtttagatgcattattattgatatctgaaaaaaactgctgtcgagttttcagttctagctttttatacatcataataggaatactgtaatgacctaagcatttatcagcaaatttcatgattgcggctgcccgatgctgaccatcgaataatgtaataacagaatccattggaattcttgccataccgaccactgaattacaaaaaaactgaaaatctatattctgatcacaattgccgaccaacggtggcaaacaaatatctgagttattctctctagaattcatcaaatagttataaataccattgacacgattccggttaatttctcgctgtgaacgatccaatacatgaccgctatcgtcactggccaaaacacgtttcaacattctaaacggtacagacaactgaataaatctgttcttcccctgcataccgtagataccgggaaattcaaaaaagtatccctcatttaattcctgcttagtttaggctgcaagtctaccaactcgtgtgattcaaatacgttcatgcgttttcttcctgttttgttgcaaaatcctgagcggtaaacagctgacaacgttgccagatagcctgacaacgttcacacgtcacacgaacttcatcaacaggacacagggaatttacttgctgggatacagtttccgtaccgcatagtgtttgaaatacaccaatacgatcacccgcaatatgcgtcaacgtctcttcttccgttaccaccccgaaagtcaaagaggcgtgcaatctcacgattggtagcaacgggtagcacacggtataaacactcagttcagggggcttattcatcagggaaaaacatccattccccgtcagcacgtcatattcgagagatagcagcgaattgcagccctgtaagcggcatagagacaactctaattgatccgtatcaagatcagcttcagtagagaaatcaacatgaacagtgacgtgatcacgttctgttacacgatggagagtaacatttaaagttcgaggaattggtttcaagttcatggttttgatccttcgccttcacgtggcgctaacgtatatgggtttattttcactaaaagtgcatattctgcacttcttatttatattaaaacacaaaaaaggtgcaaaatatacactttttcattcggttataaaaatcctctcttttgttggggtagtgatcaggtaactgcgatagccaagcttctgaacagctcaacgcgctcagggaaagtatcactctgaaatttcagaaagccgtcaataacttttttcattgtgaatcttctgtctctctgtgggatgcggtgaagattactccccatattccataaggtaaaagtctcgtttatgatgggtattatctgaaaatcttatggatgattgtcatgaatttccgttatatcaggtattttctcgccgtcgcagaacatcatggttttacccgagcggcaacagcgctgcatgtatcgcaaccagccctgtcacagcaggtcaggcttctggaagaaagcctcggcgtacagctgtttgaccgcagcggacgcaatacccgtctgactgatgccggagaagtttatttacagtatgtttaccgtgcatttcaggaactggatgaaggtaaacgggccattcatgatgtggaggatctcagcagaggttcgttgcgtgttgctgtcacgcccacctttaccacctattttatcgggcctctggttgccgaattttatacgcgttatcctcatatcacactacaaatccaggaaatgtcccaggagaggatagaagagcggttaattaacgatgatctggatataggcattgcctttgatggcggggaatccccgggaattgcatcaagaatcctgctgactgaaaccctttctcttattgtagcctaccaccatccgcgggcacagcagcgcaaaatcgctctgaatgaactcaacgatgaaaaactcatcctgctgagcgcagggtttgctacccgtgaacagattaatcgctatttttgtgaggcaggtctgcgcccgcaagtgcagatggagttcacctccatcagcgccgttttagacgtgatccgcaggacatcactttcaaccttgctcccagcggcgattgccatgcagaataatgacttggtagcgatcccgcttgctgactggcaactggaaagaacgggggtgttgatgcagcgaaaaggggcatggcaaacaacggcagcgcgggtgtttattgaagttgcacaggcgttgggtcatgtattaaatagttagttgttatgataatcctccggtatttcgtggtggaacatggctaaagtagtagagcataaaaaagtctgggcacttatgcagcaatagcttcagcttctgtcaaatagcgctcggtttcttcacctaactttattcccggataccaatgctcaaatcgggcttttaaatcattattaagtaccgctgtgcgtgtctggagtaaataatgtgcgccttgttggctccattgcatttgctgctttttcaccatccgtttagcgataacttcattgattgccgattcaacaaatgacgaggagatcggttcgccatatcggtacatttcaccataattcgggatcatcatgctgttattttcaatataggtatacatttcatcaagatgttttaacagcgatttatggttttcataatgcaatgtatcgtcatcacatatcaaggcacaatgatccaaatattctaatgccttatcgacattcccatgccagatagaccattttgtgctggttaaaacgtctaataattctgcaccgagttcaggggcgttttttgatacccctttggcatattgttttaatactgtcagacgcattgtgatatgaaaccagtcgagtacatgctgggattcggggtacaaattaaattgcagatccctgagattatcagcgccatccgataagaaggtaatttgttgattagcctgcatcccctgtgaggataactgagccaaaagttttcttctggggtgattttccagacactgcacaaaaccaaagcgtttggccggaaccgtcgcagagaacgattttccggcgatgatttcaaaatggtgttttctatcgtcccggtttctgacgtaccccccatcaatacccaccgccatcggttttcccggtttgggtaatttttcccattctctgggatcgccagggagaaaatcaggcaacccatctaattcggcctcttgtcttttagccgtctggcagaggtggtttctgactgtggcggcattacagcgttcacccaccggcaaaatatctttgagcagattggcggtcaatccataagacatcaatgaagcccatcgggtttctatatacctgagttccgggtgagtatgcgtatcacaccagttattgagcaagctaacggtgtgggttgaatgtttttcacaagcacaccggtaaacccgaaatccctccacggggataatgccaaacaaggttcgatacaggattgtctgtttaccttttatccgtcgatttcgttgacaatgagggcaagcgcgatgttcactcaggtattcggccgcctgtttctggatcaccgattgctggatagcgttcaaaagcaatttggactcagacagggaaagcccaatgtcattgggggtatcactctgtttttctaccctaaatagagtttcagtatggctgtgacctgattcatcggccaccgctatttgaattgtgaattgcatgatgttgtcctcctggggttgtggctactgtattcctccattttttagctggtgacgcaatttataatacgtagaaacacctaatcctacgttatcgcaggccagctttaacttgataccttttgctctcaacgcgtctattgggggtaatttactgatatccgcaggcggcctgcccgttcgttccccgcgctgtttttttgctgcgatcccttcggtttgcctctctcgaatgagtgcccgttcaaactgactgaaggccgacatcatatgcagttgcagctcttgcatgggtgtgcactcattagcattaaaagaaagctgttccttcaggaatatcagtgtaataccttgctgacgtaaacgcagggtcaggctacacatatccatcatattgcggcataaccgatcgatggagtgaacaacaatcgtgtcgccggttctgacctgttgaagcatatcctgaagttgtggccggttgatgtttttcgcactggcctgttcgacatacattttgtcaatttcaataccggacgcaaacagcgcctctttctggcgctcaacatgttggtcaaccgaactgacccgaatgtaggcataatgcatgtcaccctcaaaagtctttaaacctgataaagatttgtagaatactctataaaattgactttttcgaggtttatagagtgttatggtcttgttttcagcacagctgaaaggtatacttttatagaatccagtctaagccttgcgagtaatttggtgtataaaaatcataatcctttaataaccggttgagtcgatggcgattaaatttgacgcgattgaactcgtcgatgaattcttggatgtcgccaaacgttgtactgtcatcactttcgacaatggcttccaatagcttcaatgtcgcttcgatttcatcatattgagtgacatcaggcataccttgcccactgagacaaaatggcgtacttttatttgagtcaggttcaatcgcttcgatgcggatatccagtaacccatgccgatagaaattatactcataagtgaatttatcacggttttcgaaatgaaaagacgcaagtgaaacagcccagggatcattataaaaactgagaccaccttcatagctgataccatagtctttaccgtagatatgaaaggtatggagatagtcattatcccaaccaaaagcaaattgcagtaaaaaatgaaaagcgcctagtgacatatcactctgaatgcgaaaacgtcgccagatcatagggctgacatctcgaatggcggcttttactgtatatacgggcataatttccctttcaccatgatgataaagcgaacaatcatacttatcagggaatctgagcgagtagagctattggttatccgatcagcacctcaccagaacttgatttgcaagactaccgcttccggctctcacataagtgccccacagatttttatgctctcccgtttttgcgcgagttccaaacgatgcccctgagccgaaacgcctttaaacgtctccattatcccgtcgatatcattgctcaatgtgtccgtgggtatttggcctacgccctgagtttgcgtaacttagaggaaatgatggctgaacgggggattgccgttgatcattctaccctttcccgttgggttcatcgtcgggttccgttgcttgtgaaacgttatcggcggtgcaggcctgatgttgggcatcgctggcgaatggatgaaaccgatatcaaaatcaaaggccaatggaaatatttgtatcgagctgtggactcaggcggcaagacagtggattttttgttgacggctcgtcgggataaggccgctgccttgcgtttcttcaaaaaggcgatgcgtcagcatggccaaccggacgtggtgacaatggataaaagcggtgccaataaagccgcagtggatgaattaaatcaaggaaagccaaaagaggaagccattgttatccggcaaaacaaatacctcaataatctgattgaacaggatcaccgcaacatcaaacggcgaatacatcccatgctgggatttaaacatttccggcgagctcaaacgttattgagcggtattgaattggtcagtatgttacgtaaaggacaatatccgcaagaaccagagtgttttctttcacccgccgactttttctatcaattggctgcataaaaaacaattacatcattttctcttgctagcgctctgttaatgcgacagaacccctgaggtcgtgacccttgataaaagtggcgcgaataccactgcactggcgacgctcaacgccgatagacccaaagaggaaaccatccctgtccgacagagtaaatacctgaacaactgagtggagcaagatcaccgcaatatcaaacgtcggatacggccgatgttaggctttaaatcgtttcgccgggcccaaacgattttagcggggatagagcgcgtttcgatgctgcgtaaagggcaatactcacaatcagaagataagacattgtcaccggcagagatgttttatcgattgactgaataaagagtaacccactccacattgactcagattttctctgttaatgcgacagaacccatggaatgaatttgagtaacctgcatactctttggttgtattaaatttgtacataaaaatactcaagccggactcatgtccggttatcctctttgttttttcaaacagcagctttgttagcggtactcatccatcccagtaccattttctgatgtttattcaaacaatatcatgttgttgaatatttctaactttcccaaactgagtttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaagtttcaaatatttttgatattagtcacagaaaaaatagttttaattagttattaattatctgcatttttaagaacgaataggtagataagatgggtaattttataagtagaaaatttcggcaaggtcaacagttacgcttatttccacggtcattgaggcgtgatgaaggatgcattgaagagcatgatgaggaagtgtgcgctagggatcaatgggtatctaatcggatacaccgtcattgcgaatatgccccagaaaacgcgctgacaaacctccataaaacgtacgcagatagagggaaaataattaattataattgcttggacgcatttaatactaaacgcgatcctgtaggtaaagggcgcagacttgctatgcagcaaccccatgctcaattggatgaaatctatatccttgagcgcacgcactgccaattacaaggagatggtgacgctcattattttatgaaaagtatagaaccaataacgctacatgtcccagatggtcattatctatacgttatttacactgatatgcctctgacagttatatgtggtctttatgatcctaatcggattcctactataggtcatacgtcattaataaaaggcaggattcgattgtatggcaagaataaaaatatttctcagctagatgataaagatattgactatgcaaaataccctgtattgttggcaggagagctatttttcgatgatggtcgattgactatgtggaataatcggagtggtcattattttcctaaaggggataaggttgtcttaaacgccactaattgcatattgccccaaaagttatttagacaagtctggggataaagtcggccgtattccttaatggtagattagtgttgctaatgaaattctttatcacatgagaatgtgaattccgtggcgcgatctgccttccaaatcagattttgggattgctgataaacgatataatagtcagcgtttgaagaatgttattgaaaaacaaaagccgcttccggtgatcccttatcatagaaatagcgaagtgaaagttcagcgttatctcgttgctttttatttttggttatggtaaaagtattccaattattaagtctacttatatgagggttcgtagtatatcacatagtaggggttttctgaccatcaatggcattcggttaaatccttatcggcgcatcaaaagaattccatcgtgttctgggtttcatccatttccgtgggtagtgcctctctggggttctgtcgcattaacagagaaagtacgagtgaagatgaggtgattgatttttactcagctaattgatagaaaaaggctgccggtgaaatcggacccccttctttttgtcggtattgtcctttgcgcaacatacagactaattcaatccctgccaacacggtctgggctcgtctgaaatttttgaatcccagcataggatgtgtccgccgtttgacgtggcggtgatcctgttcaatcagattattaagagacttattctgccggataatgatgtcgttatcctttgttttttccttgtttaactcgtccactgcggctttattggcaccacttttatccatcgtcactccgtcgggttgtccatgctggcgtatggctttcttaaagaaacgcaaggcggcttccttatcccgatgggcggtcaacaaaaaatcaaccgtattgccgtctgaatccaccgcccggtaaaggtaacgccattgccctttgattttgatatcagtttcatcccttcgccaccgacgcccaacggcgggcttgctccgccgataacgtttgaccctcaacgggatcaggcgatgaacccagcgagagagcgtggaatgatcgacggttatcccccgctcaacaagcatttcctcgagattacgcaagctcagggcataggcctgataccaacgaacacactgggcgataatatcaacagggtagtgcagacgtttgaacgcttttcggatcaggggcatcgctctggactcgctcaaaaacaggggagcttacctgatgatcgcttaatgcgacagaacccgttttggctctaagggcggaaatggacagccggcattcacagctcccgtttttcgccacgtaatctaacgagtcgtaataggtcagcacgaaataacggaagtcgttatcgtctatctgataattcgaaccgtaataacgggcatgaagggtttcaccaaaacggtagaagatggttacccccaagatctgctcaccgcgtttggctacagcagccaccgcagtgttgatgactgaggattttttttgtccatcaaatattcgctgcatccagtcaataccttgatggctaccgtattttccccggttattagtaataagttctgccgccgcctccagtagataatcgtccagtcggcaccattccactcggttccctaagcgggaaaaggcggccagttccgcgttggttcttaccctgtggtgggagcacaattgttgtaattgcgaatcaagccccccggccggtaccgatagggtcgcttccgctgaatgcatcaatacccgagcatggggatagtaacgggcaacctcgagggcctgatgcagcggcataaaaggcataatcgttgcgtaatatccacgggtcccggccaactgggcaagcatttcagccatggccgacaatgtttcaccccggcggcccccctgcacgcaggggatttcattgtgcgtggaacagcgggccccgccccacaagaaggggggttgccaaggaccgtccaatccggggaagtagtctggcagatagaacagcccggactgatcttcgccaccccagagtgcgcaaccgcctaacaatcccgcattgccgtacagagtaaaaacgtctcccttgcccaaggcgtaatccagcccacctaaccagccgtgacggttctgttgcaataagcaaagccttggtaatatctcacttatttgttgataaaggtgtcgtcaatgtcgttgatacgaaaagccttcaaacggttacattaccccgttgatatcattgcccagtgtgtccgttggtacttggcctatgccctaagtctacgcaatctcgaagagaggatgaccgagcgaggagtacgtgttcattctaccttatcccgttgggttatcaggctcacaccattactgggtaaggcctttcgtcgacataaacgtcccgtggctcgtcgctggtgtatggatgaaacctatatcaaaatcaaaggtcagtggaaatacctgtatcgggcggttgatacctccggtcaaactattgattttttattgaccgccaaccgagataccgctgccgctttgcgttttttccgtaaagccctacgccaccacggggagcctgacatcatcacccttgataagagtggggccaacaccgcagccatcgccttgctgaataccgataaatcaaaggaaaaaactatcaaaatccgccagaataagtacctcaataagatcatcgaaacattaaacgtcggatacggccgatattaggctttaaatcatttcgccgggcccaaacgattttagcggggatagagcgcgtttcgatgctgcgtaaagggcaatactcacaacctgaagataagatattgtcaccggcagcgatgttttatcgattggctgaataaagagtaacgaactccacattgacttagactttctctgttaatgcaacagaaccacattaagccactacgcaggtaaacgtaaagtgcttaatatcttcccaagcattgataccggtgtttgtgccacatctgtccgtaaattcaaccaacttgccagcgaattggataatactgttgtattgtgcgtttcagccgatttgccttttgctcagtctcgtttttgtggctctgaaggcctgtccaatgttgtcaccctttctacgctacgtggctggaaatttcaggaagattacggggttgcaatcagcgaaggcccattggctggactgactgcacgggctgtcgttgttctggatgaaaataatcaggttatttatagccagttggtcgatgaaatcaccaacgaacctgactatgacagcgcattggcagcactgaaataattgttttattatgaataatagtcttgttttagtgttttaacacagcaacctattgtttttaaatttatatctggcgacgataaaatcacaatgaataattttatcgtcgccaacttattttatataaccccacctaacggttaagaataattaaccagtaccaaaattctcttgtccttttcaattgaaaaacattttttaaatcaaaaaattgtcttcattactacgctagtggccgcctgttttacaacctcccccccttattcacacaatcacattgccaataactaaaaagaaatatccggtataattttattgcaaaataatttttaatatgaaatattgaatatagattaataccaatttgcaattaaaataatggctgccggggttaatcgtaacaatcagtagacaaagtattttgatttgttttctgaaccttaacctaaaggctcatgcggtagctttggtctcacaaggagatttcaatggaaaggatcattatagctcactcctcattaggcgatgaatccctgctgtttaagtcattgaaaggaaaagaaaaattatcaactatttatagttttgaagtggagcttttcagtgaaaagaaggatcttgacatcaaagagttacgaaacaaacccctgtcaatagagataaaaaattctacaaacatttcagaaaaatcccgctttttaagtggaattatccgtgaagccactatctgtgattattatgaccattactactatttatataaggtgattatccaacctgagttgttcattctcactttaaacaaagatttcagaatctggcagaaaaagacggtgcctgaaattatttcagacgttcttaataaatataaaataaagtttaaaaatgaactcaatgcgaaataccagccattagaatattgcacccaatataaagaaactgatttcgattttttgagtcggttaatggaacgtgaagggatttattactatttccaacacgataagaatgatcacacgcttatattggctgattccccccaatcccattcagcgttaccagagcaggcttctattgaatattatccaagccatttttcaccgagaaacaaagacaaaaattatctatacgactggattgtaagttattcaatcaatcccaagttctataccatgagtgactataacttccttaagccaaatgcacagctaaaagaaactcagcagaatccagatccgacagtaccaaaaacagaactgtttgagtggccagggaattataccgaaaatgcgcaaggacaattttatgtccgaatactacaacaatcctataccgcgcaggatctgtatataaaagcaaaaagcatagaatccggcattgcgccaggctacaccttcacattatcaaaagccctgcgggatggagacaacggcgactatcttattgtcagtgccaattatgagtttcatgaaaatccctatattctgggagacaatacggctgatgccgacaacataaataaaattatcactgagttcaccgccatccccgctaaagtcaactggcgtgctcctcgcacaacatcatggcccatagcaggtactgaacgagctaccgttgtcggggcaagcggcaaaaccatttggactgatgaacatggcagagtcaaactcaagtttcactgggacagaagcgatataaaagacgataaaagttcttgttgggtacgggtatccaacaattgggcgggatcaaagtttggggtgatgcaggtgccaagagtgggggaagaagttatcgtcaatttcattaataacaacccagacgaaccattggttgtggggcgcagtttcaaccaaaacaatatgcctccctgggaattacccgcagaagccaccaaaatggggataatgtcacggagtttagagggcggaaaagataatgccagttacttgttgattgatgatgctcaaggaaaagagtccttcgaaatacatgccgagaaagacatgacagtctcagtggaacacgatcaaaccgtttccattgatggggcgtctatcacaaagatcaaaaacaaacaacagactaccgtgaccaatggcaaggaagtcgaagtcaccagtggtggtattcaatataaaattactgacggatataaagcagatatcacgggtgataaatcagaaaaaatcagcggctcttatcagttagaggttggacgcaattttgctaacaacatcagtggaaattacaacctgaatattacggggaataagaaagagtcagtgacaggaaacgccgaaattaaagcaagcaagttgtccttggcatcgagtaccacaatagatattaacggtgcagcaaagatttccataacggcgggactcattctattgggttaattgctcaattaaaaagatttattcggggctttcaatgaaaattatcaaacctctgcgcttaagtctgctacatcgcccttattactggcggcaacatcactatcttggtgtctccattatggctttaactgatatgggtgcctcccctcgcctgcggcctgagcctgaactttggcaacttgcagaagctgaactgaaaaccactaatggcgttgtcgatctcgccatccctaaatcttccgctgaatttcttgcaacgggctatgcctatactcatcaccagcctgataaaaccacgtgttctgcacgtatccagatagagcaattggataagacactgattgtctctggcgatcgtcattggattggcgataagccatccacgccgcaggcatttgaacagatgcggttggattggagccgtgctttcgggggaaaaaattatgaagaaaatccatatgggatcggctttacgccagaactacaggaaaatggcctcgaaactcatcgattacctaatgtagaagcccaaaacagacaacttttgtcactgcaggatacccctaatcctgcgagtttttgtcccctcgaatttgggtggccgcgccgtttcacccgtatagggaaaaaatatgacaaagagtggctggaaaatgaattccctggtttttcccgtgatatcgactggcgattgtttaatgctgctccccgcgatcaatggtgggaacactatcagacgctgccagaaaacgcagcatggcgcatttggaatatgcatcctgaaaaacccatgcaagaaggcaagctgccaccgtggcaggcgcgttgtttcatcaaacggctgcgtgctgacgaagagattttcgaagagattgccatgcgcaatacgacggtgtggtttttccctcatcgggaacagatgatcctgatttggcatggttacacacgtgttaatgaagatgatgcgactgatgttttacacatgctctccgcaatagaactcaatagcgaagcacactcagaaaatgactaccttcaagtacttaaccagcgtacagagaaagaaaaaggcgcattatatgctctgcgagaaaaagacctgatccctgaaagcattattggcccgtggatagatacagagcaatcggagcatggcagtcctttgagggagaatttgcaaaatcgcgagaaacgcctgcgtgagcaacacaaggagcgcatggcgaaatatggaaaagatatcagcacactaataactccctatattgaacaacccgctaatcccaaagcggatgaattacctgaatttgtagacaaaatagagcaagaagctgcccaaaaatatattgcagccgagcagcaacgggaaaaaattcgcacaatcgctcaagagcaaggtgttaaggtggagcaggtagcgatgcaaaacgcccccagagggccacaaaacttccaccaaatacgggatatcttgtaccaacagcaagaaagtcaaaaacaagttgagccaaaatcaatagaacttaacgataaaaaactgacacagattgaacaatctctgcataaaatgtatctggcctctgcacagacacaaccgccagccctgcgcttgaccggggatctgtcacaaattattcgcaagcaagtccagcgtattatgcgggaagggggcgatttccgtgcaatggattttaccggagcagacttatcaggaatggatctacaaggagccaatttttccggtagtttgctggaaagtgcctgtttcaataacagccaattggatggcgcagatttcagtgaagccatgttagccagagccgagatatgccatgcttccctatatggtgcaaaactggataatgccagtctggcacaggcaaaatgtgaacaaagcgatttttcagcggcaagttttaaagaaacacaattgcaggaaacgttgctcaaccattgccgatttaatcatgctatcttcacggatctctttttacaaagaaccttcatcaaacactgtcgtttccaacactcgcaatggcaaggctgcatttttattgagatgatgctacctgccctaaaatttagctatgccagcttaaataaagtttcctttatcaattgcctgctggagaacgccatttttgatcacgctgtactcgaaagctgttcatggatagaaaccgaagcagtggcaatccggtttcgatcagccaaactgctaaactgcgtgtttaccatgaaaagtgtgcttaatcaggctgatttcggttatgccacattaacggaatgtaatttacgccagacacctttagttcaggcctctttccactctgccacactgaataacagtgattttagcgaagccaactgccaattggctgatatgcagtatttaaataccacccaaagtatatttatcagaacgaattttaagaatgcattgctgaataatgccaacctgatcggcgcttttatgcagaaatgtactttttgtagcactgacttacacgaagctaatctgttccgcgctgatatgtcccagtccatcatagacgactccaccttgattcatcatgcctatacacaacgtatcaaaaccttacccaaacgtgatcaggacgtgatatgagtatgctgacagctaatgagatcatggctaagatcaaacagggagacgtcattgaacaagtcaatttgcaggggatctcgctggttggacaaaacttatcaggaggcaggttctgggctgtagacttttcagatgccaacttctcccatgccattcttgaagagtcagtctttactgaatgcctgtttgaagaaacggtcttcaattccgtcaggtgtgaaaagaccttgtttgaacagtgtaatatgatacgtgccatgttcaataaggccacactgagcgccagtgtgttcgaccaatgcgtcttaaaaaaaacacagtttaaagtcacaaaacaaaacagtacccagttttcatcctgccaattgcaatatgctgattttattgaaaatgaatttgatcgcgccacctttatcaactcagtattgcattacgcaacattacgcaatagtcacttttttctggtcaccttttttcgtcaggacttaagaaaaacggatttttatgccagtcagttcatgaaaacccttttttttgaatgtgaccaccgtgatcaagattatcgaaaattgcaatttcaggcctgtcaatttacagataatcaacttgatgcagtgaattttaatcaatccaatttgacccattgcaattttaagggaagctctctgcaagacgcccagctttcgaatgtcaatgcaacccaagcgttattcatcaatgccgatttaacgcgtgcatgctgccataacagtctgtttaatggagctatttttattggcgcttgccttgagcggaccgattttcggcaaagtcaactacaacaagccatcatgcaaaaagtacgggctgtcaacgcacaatttgtgaattgtgatatgacctatgctgatctctcttatgccaacatgaataacagcgactttcgggcagcacattttatgagaacgctttttcatcgtactcaacaggttggagcattattctctgaccgtcagggcatattggaaaatgatcctgaactgtttgctgctgaagagtggagtacacaacaacgtcaacgtaagatttaagctggggaatcaatatggtgaaatcttcttacgctctttcttcatcgactcttgttacggaacaacgatatacagaacaaccacagacgaaacaacccagtccattcccatcgcaacaaattgtcggccaagtcgtcaatatttttcaggacggaaaattaatggttaaaaatcaaaatcatgggtggcattgtcgacaagccgccagttgcctattggctcctgcaatgggtgacagggtgctacttgtagaagccgatgaacaactctggatactggcgatattagaacgggcagagcaacaagatccggctgtaatcaaggtatcaggcgatttatccattatggctcaggggaatttgaacctgagcagtaacgggttaaatatcaccgccgaaaatggaaattgccatattaatgaaatgcaatacagtggtggatccttgtctgcctgggtctccgtctcgaagataataggcaatcaatttgaatccgtttggcaaactgtaacccagttgagccatcgtctttttcgccatactacgcaaacagaacaagtgcatgcagggcaattagatatgcaggcagaaaactacatgcgactacatgcccaaaataccgtgataaccgccaaagcaatcaccaaaatagatgctgaacagatccacattggatgaaaaaataaaaaggaaacattatgtttgccaatacccaaggcggtggcacagatctggccaccccagatatctgcctaaccccatgccctctaggtgccccagtaccgatggtgtatctcaatattgcacaaggtacgaatggcatttgtgccagcacggtcaatattctctttatgggaagtccagcccataacatggcgacaatgattgccatgacgaatggagataatccgggggtgaatttgggcgttgcgtccgggacggtgatgggaccctcccgccatacgcttggagccaatagcgtcttgattaagggatcaccggcaacccggctatcaagccctaccctacagaattcaaccaatgcggtaggatcacgtaccgtccccagccagacaaaggtcgatatttcaggggcatgatctcccctgcatcttgtaaagatgggggaaattcatggtcaatataaaaaatgccagccacacaactccaccttgcagtgataagacattctcccgcgagataattgggcataaattcgcgaacagatatcgattaagtttcaagtgggcaatgatggcaatactgtttcttcacgtactcgtatttaacttaataatatttaacatcctcgtattaacagggtgttcatcatccgagcagaaaaaatcgctcccttaccaattgatttttcgtgccacaaataatgtgaatgactcagctccgctgaaaatacacgttattttgttgaaatcgacttcagagtttatgtctgctgattttttttcactgcaaggtcatgctcaggctgtactgggtaataaattgattaattctgagcaactttttttactgccttttcagcacaaatattttttgttggaaaaaaacataccagaagccaactctatcggcattcttgctgaatataagcaattggatgggaaaaaatggcgtatcgcattaccggttcccattcctgagcctcccgctttctataagttttggacatcaccgccagacacattagatatatgcattcaagtcaccgccaatggcctaaatttcatcgataaatgcaattaacgttatgccgtaagagaaggaactatatgagcagatcagaaaaagttatctggacagaaggcatgttcttacgccctcaccactttcaacaggccgaaaactatctggagacttatgtccgcgattggggtatggctcaaaggccatattactggggctttttaacgttaaagttagatcaatcattgctcgaacagggcaaggtcatggttgcatcagccagtggaatttttcctgacggaacaccctttaatttcaccgagacgcacgcccctgttccattgcaacttgcagaaaatcaaactggagaaaatgtcgtattggcactgccgatctttcgcggaggaagggaagagatcatttttcaggaaagaaaagactctatggcacgttttgtcagcgttgatgccgaggtcaatgattttaatgccatgtcagtcggaagtaccaccgtgcaatttggccgaatgcgcctgcggttgatgttggaatcagatctgactccggaatggacgtcactaagtattgtgcatgttatcagtagaacccgtgataataaattgctccttgattcacgctttattccgcccttactcaactgccatgtacatccacaacttgtcggtttcattaatgatttacagggattgctggagcaacgccgccaacagacaagccagtgtttgttacaattggggcaacaaaatagttcggaaatcatgtattttcttttcttgtcattagtcaatcgttatagaggccaagtgagccatacccggaatattcccttactgcatccagaacggttattcagtgaatggctgcaatttgccaccgaactggcaagtttttcccaatcacggataccagaagagaaacttccgatttatgaccatgacaatttgcaagtctgtttcaaccacctcatgtttttattacgccaagggttatccattattctggaagaacacgctctccagttgcctttgactgagtattctcatgggctgaatgtggcgaccttaactgacgccaatatgctaaatacattcagctttgtattggccgtttatgccgatatgccgaaagaaacactcatctcccgttttccggcacagatgaaaattgcccctgttggccgcatacgtgaactggttcagttacagttacccggtatcccgatcagtgcaatgccatccgttcccagacaaattccctggcattccggttacctctattttgagttagaaaaagagggtgaactctggagccagatggcaaaatccggtggttttgcgttacatctggcaggtgaatttccgggtctgcacatggaattttgggctgttagaaatcagtccaagagttgacgcctcaaaaatcagaatcaaaagaacagaggtcactacacctatgactccaaacactcccaacaggcatacggagctttctggcgacacttgggataatccattagtcactgccgctaaccctctattaaatagcattcctcagatccgccatgataccgagtccccggatccaaccgttctacggcaaaaactgatcgatgaaattcgccactttgaactgaaatgccaatatgccaaattgccttatgaagtcattatcggtgcacgttactgtctgtgcaccacattggatgaagcggcagcactgactccgtggggcgttcgcagtgtctggtccggcagtggattgctggtcacgtttcacaacgaaacatggggaggggaaaaatttttccagttattagcgacgttatcccaaagtccccaaaaaaatctgttgttgttagaactcattaacttttgtctccagcttgggtttgaagggcgttatcgtgtcatggataatgggcgaacccagttggaaaccttgaaacagcgcctgttccagttaattcattccgttcgtggcaattatccgcctgaattatcacctgcattgcaaaaaatcgtggcgccaaatcatccctggcaatcgtctttccctatttggtcctatatcgcggtaacctgtcttattgcatgtattctgtatatcgggctgaattggcagttggataatataaccagcccaatattgacgaaaatatatcaagtcaatttgcccaatatgtccgttgatgatcgcgtttcttctttcctgccgccggtcttaaatttacaggatatgctcagacgtgaaagtgctgcgggattattaaatgtcgcggatttggctgataaaagtatcgtcacattaaggggcgatggtttgttcaagacgggttccactcaaataaaaaataattatcttcccgttatcaaacatattgctgagaccatgaacaacatcgagggggaaattttagtaatcggctataccgatgatgttcccattaatagctccagcttttcatctaattatgccttatcactcgccagagccaaatcagtaaaaagggaattcgaaaaatatctggatcaccctgaacgggtaagaacagaaggaagaggagaaagtgatcccctatttccaaacgatacgcccagtcatcgagctaaaaacagacgggttgaaatcattctgttaatttcccctacacatcagacaacgtgagaatacggaaatatgttgagcgccattgttgctatttttaccagccgattaatgtggagtttcctcggcatcaccgccatctcttccattatctggtttattggtcccatgacttctatcggtaataccatacctcttgaatcaagtacggtacgaataattatcattgccacattatattttgtctggctctttatccagttagcgtctcacttatatcaggtttggctgaataaaaaactttctgccccattaaacagaggcaatggcgagggtgaacaattacgaaattcacaatattcccccttatcagaacacttttctgatgccttacgactactgaaaaatgcctatttttatggttcagagatccaatataagccaaaatggaaaccttttttcgatcgtcgatatcggtatcagttaccttggtatgtcctgattggcgcccccaattcagggaaaacaacccttctggaaaattctggtttgcactttccattatccgatcatttcgaaacgctttcctcaaacgagataaaagaaaccgataattgtcactggtggttcaccaatcaggctgtcttactggatacacccggacgatataccactcaggatacacggcacgaacaagatgcccgtgaatggaaatgttttgtcaatttgctgaaaaaatatcgcacacgccagcccctaaatggcgtcattcttaccattagcgtagcggatttattaaacccctcaaagaaagtacgtgatcaacacgcttatttattacgcaggcgattgtcagaattacaggctcagttcaagatccaatttccaatctatgtcatcattaccaagattgatttactgaaaggatttggggcttattttgcccattttgacaaaacacagcgcgatcaaatctggggattcaatttcccgtggaacaaaacaggctgggatctaaaggacatttttgcacagcaatatgggttgttgcagacacgattaaatgcagggctatcccatattttattgcacctgaatgatcttcagcaatgtgctgaaagttacctatttccgcaagaatttgccgcactgcaatccttaattgctcagcatcttgaaattgcattcgctaaatcagggtttgatattccttattcaccacgtgggctttatttcactagcggcgtacaggaagagcctattcatcaagggtattttctgaaaactctgctggaaacgctctttcaggaagccgggcttgccggtcaaaatcgttggtgggtgtacagaaaccgtctattaaaagggctggggtatattattctggctgcgatcatggggttaatcatcaccttgttttttagcagttataacaacaataaaaattacctgatagaagttcaaaataaaattttccctattctgagccaaagcgcaaaattaaaaaagatcagcaacgacatcgatatttatgccttactgcctattttgaataaagtggcggatttgggaaaaagtaaatatttttctcctgatgctcccccttggttataccaaatgggcttgtatcatggtgaacagatcaatggtgccagtttgacactgtacacgaaaacattacaaaccttattgttaccgcaagtcgcacggttaataacgtctcaattgcaccaaaccaacagcgataatatagatgacacttacaatacgttgaaagcgtatcaaatgttatgtcagccccaacattatgacggtaagttcttacatcgttgggtgatgcaatatttgcaggctcatttaccccccactatttcaccggcacaattacaccaaattgaggggcatctgcgccaattattggaatatcaggtcgttactttcccttatgtttgtgataacccactgataaaacaaaaacagattttacttagcaagatcccaccagcacgactcgtttatatccatttaaaacaggaactatcggataaccccaatttatcgccagtcggcttaacaacgcttgctggcccagaagccggattggttttctcgcgcatcaacggtacaccgattacccttaatatagcggggatgtttactccggcggggtatcaaatggggataggtaacaatctcactaccctcatcgataagttatacagtcaaaatgcatggatactgggccagtatgcagaaatatcaaccccaaaagagcttgcccttttagtacgaaaattttatctccatgattatcttgaacagtgggataaatttctgttcgacatccgtctaaacaatattgacagcctggagcaacgttccaatatggcccagttgctggcttcaaatgcttctcccatgcgcaatctgctcattaatatcagtaagaatgtcaatctgaatgaagggttaagcgatagcaaatttgataaaaaaatcggtgagttggtcagccgtaaagcaggttcattgacaaaagtcgtacctaatccattcatgtcaggagataacccccccaccccggaacaagaattgagagaacattttacccaaattattgcattggcaaacaatccagacggtaaaaataagcaaattccctttgataacattctcagccaacttgccaaattacatgaatatctggattcggtacaaaaggctaccaatataggcatacccgcgccatcggatgaaattatcacccaactccaagccacggcggagcgattgccgatcccattcaagggcatcatttcctcgttggcaatgggggctaacagtgatacacaagccagtaacgtaaagaatctcaataagcaactgaatacagaagtccaaggcttttgtcatcaagcgattgccaaccgctatccgctgacgccgtgggcacttgatgatatcagaccggatgatatggcccggatgtttgcgccacaaacggggatcatggatagctttttccagaaaaatctggtgggaaaagtcgatacatctcacgaaaactggcgccttatactggggacggatagcaaagcattaccggaaaatcacaaattactcctgccattccaacaagcccagatcattcgagatactttattcagcaacggctcgcgtatcccttcatttcgggtcatcgtccgcaccgtaaatatggataaagagatattgagtatgatactggatgttgatggccagcaattgcaatatagccacggcccacaagtttcgcagtcactcaattggcctggcccaaacggctccaatcaggctcgtatccaattaaatttagatgatgggacaacagcgagtctgatcacttccggcccgtgggcattaaatcgcttaattgaccatgagcaacacgcgacaggaaaacccgccacaaataatcatacaagccagcgtgtgacatttaatatcagaggccatcatgtctcattggaatttattccaaacagtattctcagcccgtttcaacttccccttttcgtctgtcccaagctgattaattcataaaaatagatggcctatacccatccaacttcacgttgccgcttacaaactcatgtgagtgtttatacctctgcgcggggaggtataagacgcatcttgaaaggcgacggctatattcaaccatcaatattttcaactatcagaaaaagtaaaccctattatgaacatcgaaaccttactcgaacccgtcagcatcgaatctccttgtggggaaaatctggaatacgatcctgaatttatggcattagagcaatatttgctcggaaaaacggaacagcagtttggtgatatcactattccagcggagccacctgactggatacaggccgaaaaacaagccattagcctactgaggcggaccaaagatctgcgcatcatcatggcactgacacaatcatggttgcaaatgcggggattatgtggctacgcagacggcctgaatctgctccagcagacactggaacgctattgggatgaagtttggccgaaattagcgtttgagggggaatatgatcccctatttcgcctcaacatacttgccgctattgaggacgattctcctctttcgttgcaagcgcaatattccactctgttgcggaacgcgtcaaaggagttgtcattgctggaggtttgctcattactggatggcacgataaacgaaatcagcggctataccggcgggcgaccccgattacaggaggagttaaagcagcaggccagtagccctgaagttttggccgtgatccgtattcgggatcacctcattgcaatactcgacattattcgtcaggcattctcagaaagctatgttcctgaattgtcttggttattaaaacaattaaataaagtgattgaattttgcccttccctctcaaaaacaaggcatcgcgataaggagccagaccccaaaaatatttttgactcaacaacatgttcggaacagagaacgcctgcatcgacatattcaacccatgcggtatctgcttcttggcataccattgaagccagcaaccgtgatgaagcacgcatgttactagaaaaggctaaaaactattttgtcgtcaatgaacccagtcaccctgccccacatatgattgcccgcattcagcggttgattgatcgtgacttcgttgacattgtttatgatcttgccccagatggactcaaccagctcgaaatcattttgggtcgcccagacaattttgactcgaattaatcgtcgtgttctcaacaacctatcaagccatttgtcgttttatatccatccaacttcaagttgccgcttgcaaacccatgtaagtgtttatacctccccgctacgcggggaggtatcacgcatcttgaaaggcgactgctatatatccgattaaattagctaattattagccagtaatggagaatttgtcatgaaatccagtggacaaaagtttattgctcgaaatcgccctccacgcgtacaaattgaatatgatgtcgagctttatggttcagaacaaaaaattcaactgccgtttgtgatgggagtgatgagcgacttagcaggaaaaccattagaagccttaccggaagtcagtcaccgcaagttcatggaaattgacattgataactttgatgaatgcatgaaatcaacacaaccccgtgttgcttttcaggtggacaataccctaaccaatgatggaaaactgaatgtcgaattaatctttgaaaaaatggaagattttcagcctgatgccattgctaaaaaagtagaacccctggctaagctactggaagcacgaacccaactggcaaacttattatcctatatggatggcaaaagcggcgcagaacaattgatcgccgatatcctgcaaaatcctgccctgctgaaatcactggccgatgccccaaagcccaccgaaagtgttgctgatacagacagtacgaccaacacagaacaggctgaaaataaggagtaattcatgagtacgactgaacaagaaactgaatttcagcaagagcagctctcaaaagaatatacccctgatgaactgagtgtattgctgaataaagaatttcgtccgcaaagcgaccaggcacgaagcgcagttgaaagcgctgtgaccacattggcacaacaggcgctggaaaatacggtcacaatctccggtgatacctaccgaaccattcaagccctgattactgaaatcgataaaaaactatcacagcaaattaatcatattttgcatcatgatgaattccaaacgttggaaggggcttggcgggggttgcattatctcgccaataacacggaaaccgatgaaatgttaaaaatccgtgttatgtgtatttccaaaaaagagttgggcagtacgctaaaacgtttcaaaggtgtgagctgggatcaaagccctatctttaaaaaaatctatgaagcggaatatggccagtttggcggtgagccttatggttgccttatcggagattattatttcgatcacaccgcacccgatgttgaactcttacgggagatggctcagattagtgccgccgcgcattgcccatttctttcgggcgcctcaccaagtgtgatgcaaatggaatgctggcaagagttatctaatccacgggatctcaccaaagttttccaaaataccgaatatgccccttggcatagtttgcgtgaatcggaagatgttcgttatctgggattgactttaccccgttttctctcccgtctgccctatggtaataaaacaaatcctgtcgataattttaattttgaggaggataccgaaggccctacccacagtaactatacctgggccaatgcagcttatgctatggctgttaatatcaaccgctcatttaaattatatggctggtgtacttctatccgtggcgtagaatccggcggtactgtagaaaatttgccttgctatactttcccaaccgatgatggcggggttgatatgaaatgccccaccgaaattgccattagtgatcgccgtgaggctgaattggctaaaaatggttttattccactcttgcatcgtaaaaatacagatatggccgcctttatcggtgcacaatcacttcagaaaccttctgaatattacgaccaagatgccactgctaatgcaaatctttcagctcgcctaccctatttattcgcctgctgtcgtttcgctcactatttaaagtgtattgtacgcgataaaatcggcacatttcaggaacgtagtgatatggagaactggctcaataactggataatcaattatgttgacggtgatccgaccaactcttctgcaggaaccaaagcacgaaaacccttggctgccgcagaagtacaagtagaagaaatcccaagtaatccagggtattatcacgctaaattcttcctacgcccacattatcaattagaaggattaaccgtttctttacgtctggtatcaagattaccttcattaaaaagcgcttagttctctaatattaggagtaacattatcgaccataatattattgtctttcatcttttatttcccatcaacacataactgttactacataaattaaaaccattgttcttcattcaacattatttattgttcattgttgttataataaatagaatttgaggtgtaaccatgtctgatttcaattccatgtataatactcattctttcgtccaattcgagggcattgagggtgaatcgcaaactaaaggttatgaaaaatggatcggtgtccaatttattagtcgtgccataattaaccctgctaatgtctcaaccgatacaggaagctggggttcaggtaaaggtgttttaaaccatttcatgcttcatattaattatgataaggcaataagcgccttagaaaaatacgctgtcacgggtaaacatattaagacaacaaaaattcatatacttcgtttcattggcgaagctgaaccggcaatatgggctaaatatgaacttaccaatacttatatttctgaaataagcagtggacaaccttccgataatgtcatcacggttggcctaaaaatgaaaaaactccaattaaattacacaccagcagattatgaaggtaaaaaacaggctgaaaccacctggacctgggatatggaaaaaaatgttatcgaataatattcattatttattttatttgctcatataatacgaccaataacctctcttcggggaggttatttcccaccagaaataggcacctatcattatgcgattcaccattgttaaaaatattggtacaaaccagccgcaacaactgagttatgattttatgccgcccggtggcacaattggccgctctccagataataactgggttttgcccgatgaagggcaggctatagctcgtttacaggccactgtatctgtttccatcgatggagaatgtcgtattagcaatcggggggctgcctctgatattttgttaaataccatccccatcgctcccgaccggaagattgaaatccgcgatggtgatacgttaaatatcggtgattaccaaatccaagtcattaatattaaccaaggttcgaataatacgaatagtgtgaacacgccaccattggcaacaattcgcaaagatattcacagtgaaatttgggatggattggagaatacgtttacgtccgatgaaagcatgcctcagactccccaacaaattgctaagacactcaatgacaataatccactcataaaatctcagcgacatcaggaacgcaatccaataaaccctctcgaacagatggaaacaataattgacctagattccctgcaattccgagccactgatccaatcacgatgtttaatgcaaacacggatagccagcaagaaaatattctcaatgacagtacgcccagtaccttattgcagcagggcaaccagcgcgataaacaagaaattgatcccttgattttattttccgataaacgtcggcgggggattttgcatgatgagccgctaaattgggtgatggaaaatgctgaacctttggtcgcacaggctaatacaggcacttctgaccctcaatatggcgccagtgatccccctttccaccgtcataacaatgaacgcttggatatcgacccagtgacatatccgcctaatccccatcaacccgatcaggtcgaagaaggtgttaaattagagggtaaactcttagccgctttattggacggtatggggcttaatcatctccaaaacctgcaatttgatgggcataccctgtataaactggggaaattacttagccagttatcacaaggcattatcgcgttaaatgcgtcacgcacgcagttgaaatatgaaactgataccggagttgcccagatcctggtggatggcaacaatccctttgcacttcttccttcgggtcaagcggtgctgatccaaatgcttggcgatcatatgccaggatttatgtcagcagaacaggcaacacgagatattttaatcgagttacaagcacatcaattaggcatgattgcaggtttacgcactattacgacagagatgttacaacgatttgatccctccgtgattaaacaaaaagcacaagaaaccggcaacctgcctcgtttggcattatcatcaacttataaagcggctttatgggattatttcatcaaacattatcagaaaaccatggaaaaaattgaacaggatcactctgtatttggtgaacactttcaacaagcctatgaatcagaaattattcgatataaacactcgcaagataaattaaaaaatagagataaaaaataatatttcgtacaattacgacatttaatagataaccgatagttaatagatgaataataatgaaagataatatcactttattacatggcggttatcattttcgaaaacctcctgcacgcatcactgccagagataggatgcagtcttctttacttgacagacttaccgacaacgaacctgacaagaaaaaagaaaatacgaaaaattatttattatcacacagaacctttcggcaaaatatactacgggatttacaatggttactcaacagtattaataaagaatctaatccagaactttcttgtttccctgaaatacagaattctacttataactttggcatagctcccctgtcgggtaaaaacatgtccgatattgaatggagtgatatccaaaataaaattattaaagcgattcatatttttgaaccccgtattatttccagtgaactgcaagtcaattgtatttcaaatattcattcactatctctatacaatatattgtccatcgaaataaaaggatttttgtggtgtatcccctggccaatagaattcctgtttcgcagtgacatcgatctggaacacggttatttcaccatgaaagaagctggataaaaaaacaagagaggagaaccatggatagcaaactgctggaatactataatcgagaattggtgtacttacgtgaaatgggtaaagagtttgccgagcgctatcccaaaattgccaatcggttaggaatgcacggcattgaaatcgccgatccctatgttgaacgcctgatagaagggtttgctttcttgacttcccgcatccagctaaaaatggatgccgaatttcagcatttttcccagcatttactggaaatgctctatcccaattatctggcgcccaccccctcaatggcaattacagaactccaacccgacatgagtaagggagatatcagccacggttttctggtgccacacggcacgattatgcgctgccaatcactggagaacgacggcattactttgcaatatgccacggctcaggatgtcatcttacaaccgctgaaactacaaaaagttgagcttggcaaaatccccgccaatattcctcttgtgggtttaaaccttcatcaatatggtgcaatcagtgcattgcgtatccgccttgcctgtaagggaaagttctttctccacgatttagatctcaataaactgacattttttctttcagggccagatattcaatcccagaaactgctggaactgattatggagcactcggttgggatggtatgccaaactttgggggcctccccacaatacctgacattgcctgacattgctccacatcatgaaggttttgatgatgagcaagccctcttacccaatgatccccgtaatttcagtggatatcgccaggttcaagaatattttgcctttccggcacgttttcgttttttcagtgtttgtggtatgcaatctttgctcaaggagacgaagaaagacgttgaattcgagcttattctgctcttaaacaaaaccgatagcagtttagagagcctgatcgacacttcctatctggcgttgaactgtactcccgtgatcaacttatttcccaaaatgaccgagcgggtaactgttgatgaaagtaccaatgaatatcatttggtcgtcgataacatccgtccattggattacgaaattttttccgtacaacgcttacttggcgtcgacgcacaacataaacaagaacgtatatttcgtcctttttggtcaaccaatagcgatgaccagggtaattacggtgcctatttctcactgcgccgggagccacgcatattgtctgaacacgcccatcattatggcacccgcactagctatatcggcacagaaacatttatctctattgtggatgaacattactccccgtggcctgatacattaagatatctgagtgccgacgtgatgtgtactaaccgagatctacccgcaatgttgcggcaaaaagatatcaatagctttgccatgctggactccatccctatcagtaaaattgagtttattaaaaggccgaccatccctcgccctgctctggctgagggggctgtatcatggaaattaatcagccagcttcaaattaattacatgaattttatggatcaaaaccaagaagaaggtacccaggcactacgacagctattaagtctctatgccgatcttgctgagccagcagtcgtacgccagattaatggcatacgacactgctcattaaaagaagtctatcgtagagtgcccgatactggccctatcgtttttgcccgtggtgtcagcattaaactcgaagtcgatgagcaggagtttgccggcgccagcccgtggcttttaggcagtgtgctggaaaaattattctcgcgtttggtcaccataaacgcctttactgaaatgacactgtatagccagcaacgtggacaagttggcttctggcctgcccgcatgggcagcaagaagttaatataagtgatgtgtggacaagcccacaaagtaacaatgtgcgagaagatggggattgaatatgaaaacagatattacggccattcatcgtgtatgccgtttgccagagtatttttggcaacaactcacccaagccccctggcaatttgatctgttccagaccctacgtcgcattgatgcccaagcgggagggtattaccgattagggacagccccattaccacgctatgaacttttgcgcttggggcaaaaagcgtcaatggcattcgcaccttccacaatttccacagtccatcagctaaaaaattcaaaactctacgaagtgcttatttacagcttcggattatttggtcccaatggcccattgcctctgcacctgactgaatatacctattcacgggaatataattatcaagatcccactttgggtgcctttaccaatctatttcaccatcggctgatactcctgttctatcgagcctgggccaatgcacaacctacctcatcattagatagacctgacaaccagaagttttgtcattatctggcttgcctgatagggatgggattgtcagcccagcagaattccaacccggtcaatcacgataacattatccgtaactctattaacaatcatgcccgttacgcgttgtccggccatctttcccgccagaggcataatgcggaagggttgaaaaaaataatgcttttttatttcaaggttcccgtaaaaattatccaaaatatcccacaatggttgcagattgaaacgcaagatcaggctcgactggcagcagggcgtcatgtgccctgtttaggtaagtccgccattttgggcattgcaatacatgatattcagcataaattccgtattgaactagggccattaactcaggcagagtacgacatgtttctgcctgaacagacgaaatctcaacaagtgcgtgagtgggtttatcaatacttaggtatcgagtatggctgggatattaggctgatacttgataaatcagacatcaccgaaatgcgcctgtcaaaaacggggaaattgggactcaatagctggctgggtaaggttaacaaatcaagccattatgatgacttaatctacaaccctaaatcctgcaagacacattaaaacctattcctccctcaacgccaatattgctgcgggtatatttatgccagaaatcagccgttctgtactctttggtaaactcaatcgtgtactcttcacctcactggaaaatgcgacaactttctgcaaactacgcagtaatccttatgtcgagttagtccattggctgcaccagcttatgcagcaacaagactgtgatttacaatcggttatccgttactttgcattagatgaagccaagctggcaaaagatattattacagcactggatcgcctgccacgtggagccagtgcgatttctgatctttccgaacatattgatagtgccgtagagcgtgcctgggtatatggatcattaaaatttggtgttgacaagatccgcaccgcgcactggctgattggtatgttaaagactttcaatctgtacaataccctgaaagccatttcccgacagtttgaacaagtcaatgcagatacgttaatagataatttcaacgccatctgcggcaacagcagtgaagaaccggagaatgaatcaccctctcatcattcccaaccgacaaaaccacaatcctctgacagtgccctgcggcaatatgggcaaaatctcactgatctggctcgccatggtgatattgatcccgtatcaggacgcgatgaagaaatacgccagattgtcgatatcttgatgcgccgccgccaaaataaccccttactgaccggtgaagctggggtcggaaaaaccgccatcattgaagggctggcattgcggatcgccgcaaatgaggtgcctccaccactgcaaaatgtgcaactttggctattggatattgggatgttacaagccggggcgggtatcaagggcgaattcgaatcccgcttgcgcagagtgattgacgaagtgcaatccagcccccttccgatcattttattcattgatgaaatccatacattaattggtgcaggcgggcaacagggaacgggggatgcggccaatttacttaagcccgtactggcacgtggtcagttacgaacgcttggagcaaccacctggtctgaatacaagaaatatattgaaaaagatccggccctcacccggcgttttcaggtcgtccaaattcatgaacccgatgaagccaaggcacttttgatgctacgcagtttggtcaggacgctggaaaaacatcaccgtgttctcctactggatgaggccgttgaagctgccatacggctttcccatcgctatattcccgctcgtcagctacccgataaggctgcagctctattagatacggcatgcgccagagttgccattagccaacacgctgaaccaccacagttggaaaattgccgacataaaatcgatgccttgaagattgagctagaaattgttgaacgagaagcaaaaatggggataggcgatcagcaacggtcaaataccatcctcaatgcgctatccctattggaagaacaacgtattcaattggaaaaccactggcagcaagaactctccttgattaatagaattattcatctgcaaactcaactttatgaacccccctttcatcaacaacagcataatgatcccaatgccctgcatgcagaactgatagcattgcaacaacaattaaaaatgttgcaaggagagatcccccttatctttgcttcggtagacagcaatgttgtttccgccgttgtctcagactggacgggggttcctcttagccgcatggtaaaagacgaaattaatgcggtattgcatttggcggatacactcaaccaacgagttatcgggcagtaccatgctttggagttgatcgcaaaacgggtacgaacttcacgggcaaaattggatgatcccaataaaccggtgggggtgtttatgttatgtggcccttccggtgtcggtaagaccgaaaccgcgctggcattagcggaaacgctatatggtggcgaacagaatctgatcaccattaatatgagtgaatttcaggaagcccatacggtatccactttaaaaggggcaccaccagggtatgtgggttatggtgaagggggagtattgaccgaagccgtgcgccggcgtccctacagtgtggtcttactggatgaaattgaaaaagcccactctgatgtccatgagattttttttcaagtctttgacaagggttggatggaagatggtgaaggccgccacattgattttcgcaataccattattatcctgacatccaatattggggctgatttggtgagttcgctgtgtttacaacaggcttctcttccagatccagaaaaactgagtaccgcattgcgaaaacccttactgcacgtattccctgctgccttactcggacgtttgattgtcattccttactatccattgagtgataatgtgatgacaagtattgttcacctgcaattggcaaggatcaaaaaacgtttactggaaaaccatgacattgtagccacatttgatgaacccatgattaaatatatcgttggccgatgtacagaaatcgaatcaggtggccgtatggtagatgctatcctgaccaactccttgctgccgcagatcagccagctcttgctctctgctaacgcgaatggtcagcaatatcatcaattacaagtctctctcggacaaggtgagtttcagttccagttcatggaatgaacttgtgattaagagaatatttattaacctcagcttcgtttaaagatagcgatttcattatcccgtagattcaagctcggttttttaggttggaatgtataagcaataagaccggcagcaacttccaacaaaaaaccgagctgactgcgatgccttgaatgcgctatctgagaaatatttttgagctggtcgacgaccgtttctatcaaaaatctccgtcttaacatcaacctatcccagagagataatgctttggttttcatgttactccggacattggtgattaacgtgatgccttccgcttctaactcatcgcataaagcctgggataaataccccttatcaccatacaaacatcctgttagtccttttgtcagcgctctgactggctgacgatcatcctggtttcctgtggtgagtttcacggctaacaattcaccgcaatcattgataaccaaatgaagtttaaagccataaaaccagcctgtactcgttttacctcgttgtgccatcccttcaaatacgcgatgacggggaaaacgaagattgtgacaaacagcaattttggtagaatcaataaaagcaatcccttgagtgtgcgccttacgtgatgaaagaaaagcgcataaaggaataagcgcccttttcttcagggtgaggatacgagtatagctgactaatccgggaaaatcggctgtaaaatattgttttacatgttcaatataaaatgttttaaaatcacgataatgactcatatgaaataaaatgaggatcatcatgacttcactgagagaaagggatgcctcacggtgccgtttacgtaatccattttcaatgagttgttgatgccagagagggataaatttttggcaaaagtcatcgacgcagcagtaaagttcttctaaattagacatgcctgagggtctccactattttgttttctttagcaaaaacgttgatcgtgcctcaggcactttagttcccttcccttaagcgaagctcaggttaggtaatatctcacttatttgttgataaaggtgtcgtcaatgtcgttgatacgaaaagccttcaaacggttgcattatcccgttgatatcattgcccagtgtgtccgttggtatctggcctatgccctaagcctacgcaatctcgaagagatgatgaccgagcgagggatacgtgttgaccattctaccttataccgttggattatcaggctcacaccattactgggtaaagcctttcgtcgacataaacgtcccgtggctcgtcgctggcgtatggatgaaaatcaaagggcaatggcgttatctttaccgggctgtggattcagacggcaatacggttgattttttgttgaccgcccatcgggataaggaggccgccttgcgtttctttaagaaagcaatacgccagcatggacaacccgacggggtgacgatggataaaagtggtgccaataaagccgcagtggacgagttaaccaaggaaaaaacaaaggataacgacatcattatccggcaaaataagtatcttaataatctgattgaacaggatcatcggaatatcaaacgtcggatacggccaatgttaggttttaaatcgtttcgccgagcccaaacgattttagcggggatagagctcgtttcgatgcggcgtaaagggcaatacttacaacccgaagataagacattgtcaccggcagagatattttatcgattgactgcataaatagtcatcattcccacctccgtacaaactttctctgttaatgcgacagaacctaaaattcacatagtaggtaagctaactgaccaatatcactacagtgtaggtatatttttttgggggctcatatggcttttacgagtaaagtccagcttataagcatatatccagacgcacatatgtcatcacatcaaccttttatgatggatatacaataaacgaattcactnnnnnnnnnnnnnnnnnnnnnnn

SEQ ID NO: 16910 - DNA, 31355 bp, Xenorhabdus bovienii
  unsure (1)..(31355): unsure at all n locations
nnnnnnnnnnnnnnnnnnnnnnnnnnnnnnnnnnnnttatgaaaaaacttgggtaacaagtgcggactaccacatttccatatttttgagtaaatgttatggttttggccgcaaaaagctttacatgtgatgtaaatatatatcatgaagagactcctggtacattttttgatgctcttggtggccttacaccttcccaatactgccgatggttgtggcgacgtaactcgaatgagaacggtcgtcatttgtatgtccctgtaggtcaaactaaacgaaaacgcaaagttacttcttcattatcttctttctaccttcaaatcaatacagatgaagatctctacttcactcccaatacgtttttcgactggcgtaaaaaagcgctgctatcggggctttgtgcaaattatgtagagatagatacgtctattgaacggatgctgactgctaatgagtctcagcaggttcttgatgaggtattgcagcaggtagctgcttcaggtacaccagcccctaatgccatcgttgaaagcgggtcaggcggtcttcatctatattggttctatgaaatgattgatgcttttccggcacagaagctagcatgggaatctatctctaaaacgcttactgataggtttactggcggcgatctatggcatgttgataccggagcatcccatgacatgacaagatttctacggttcctggttcgaagcattctacaacggggaagtgcgttaagttttggttgtcagaccaacagtattcttccaaaatgttggccaacaagctggatgttgtttattcgccaccaatattggaatcattaagagtaagtgtcgtatttatccttctccctcaccaagatttactgagcctgaaagtgataccccggctcggcatagtatcgccaattggtggagccgtatctattggcatctatccagctttatcaggagttccaagcgaattaagttaggtcagcgtgatagcgttgcgtttatcgcctttgttgcactacgccgtattacgtcaattaataaagcttgggagttaattcgagaacttaacgataaacatattggactgaaaccagatgagttagatcagtatctatcaagtgctgtaaagaccatatatcgatataaaaaatccactcttgttaagtatttttcaggggccggtataccaatccctgattttctattaggtgaaacaaaacgctggaatgtgtcacttggtttaaccgtagaggaaattaagaagagacaggtaaattcagggataagctcagccaggaagagaagcaaacgtaataggatagctatctttaatgctattcagacattattagctcaagggaagagtgttatttcgtctttatcggttgcgtctatggcagggtgttcgcggaggacagctcaacgtgttttagcgtcattcggtgctcttgtatatccgctccccgtaggggaagagttgtttttttgattttttatttgaatgcttattcttattttctgttatttgagtaggtatgatgtgactgatctgagaagctaagtcatgataggattattctatatgagtaaggcttttttttgctgatttttatatttggttgaatgannctcatttattttatnttaataattggntattagggaagaatatctactattctactcggtgtatacaatttacctttagatgtgattagtatgactgtcttgataatatctgacactgaggttttgtttgataactttaatttatttttttaattgttttatctgatctaattcctcttttttaaagtatattttctttatagtttaaccctgttctttaagccgatttatgtagttctgataaggttgtttatacggtacatagtgcttggtttaggtagccattttttaaaaacttaaaaataacacttttctgtatcatagatatgatataaatttatataaagatttagagttttttgttaggtgctaaagattttttgtgcatgcacaaatctgatggcgagtaaaatagtaatcgtcttgtgcatgcacaaatctgaagaaatatttgaattaacttgttgtataaatagtgttttataaaaataactgtcaagagaaaagtttgtgatttccgtcaactttttagaataaatcctacaaaacctagttgccaatatgacagataagtgtaatatatattatgaaaacgccttcggaggcgcaggataatcatccataaccggagatttcattaatggctaagtctgttaagagtaaaaaaactggttcgtctgttagtctgttgcacaagaaaattgttgaggcaattcgcgctgctcatccaatctttggaaattccaatgataaagggggggtaggtaaaacgacagtaactgcacatgaagcttggtatttagctagtctcggtttgaaagtgttggtaattgatttcgataaacatataacgaaaatgtttttcgaaaatgctatccctgatttatctgaatttgcatatgctagtgatctcttcagtgatgagggtataactaagccgatctatgaaatgcctaatcaccaaaacatctggttcctgcctgctgagcatgaaatgaaaggtattgattcgcgtccgatgagttctggcatagttgtatatccacgctttcatttacaatcattacgtgatgatttcgacgtaattgtaatcgataccccgccaggagaaggcaaccgtcaacaagcaggactgctggcttgtactcatgcggttttagttactgaaatgggggcgctttcaataggtggtgtaagtgacgccatttctataaccaatgaacttattgacaatattaatgctaataatccagatcaggatatgacaaagccttcttatattgtcattcccaacaaatttaactctcgtagaagccgccataaagactatctagcacagcttaaacagctagacgtgaatttaacaccgtgcatcaacgaccgtgaaactttcggcatatcgacagataccgcgatccctgtctggaaatttgatgatggtaatgctcgtctagcagctaaagaagttaagaatgtcttaaactatattttcttagaggtggcaaaatgaccaagaaaccttttactttaaatattccggcgcttgaatcaatttcgcgttcagcttcagccaatcaaaagaatatagctggtcaagtgttctatgttgatccagatgagtgctatgttgtagtaaacccgcgtacaaaatataatgaagcgctgattgaatcgtatgtccaagatttcttagatgagcgtcagggccagcgtgagccttgcacggtgtatcccaaggatgataaaggctatcgcatccatcatggcgctacgcgcacgttagcgggtaagaaggctaaggaaattaagtctgattggaagttaaaaataataatcgatcctagtttgcaaacacgcagcgatttcgaaaattattgggaacaaggcactaataatgtcgcccgagataatatgaacttactcgatgttgctaactggataatcaaaagcaaaacattagcaaaagctgaaggtaagactcttactcaagaatctatagcgaagagtattggtcaaacaggggcttgggtatcgaaagtgcaagctcttgctgagttaccggactacctaattgaagtgtaccaaaatggtgaaacagttgatccttggacgcttaactctttattaaaaatccataaagctaatgaaagcttgtgccgtgcttttatcgaaagtggagaagtggggccgcagcagcgcacagaaagtgttgaaagcaatgtctcttgatgtgctgaaagcaccaactgacagcagcaaagacgcggggctacaacctgttactagtcaaagctcaacaaatgaaattacttcaaaagaaagtgttatgactagaaaccaagatgatgaagtgatttttgatcttgtgcatgcacaaaaaattgaagttatgagtggagtaacgggcgacgctttcatatatgtccagccaatagataatctatggatctctacagctgagactacttttgaacatgagtttaatgccacaccttctatttcttctaacttgaagtttgcgagtaaagaggccgcagaatttgcagccttagtttcgttaaaatctgtggctgagaatattctagtgcaacgtcgctctctgctagaagaagaaagcagagatgcggaaatgttgttatcttcgatagatataaaattaaactccaatggcacagaaaataatgcgctaacaggtagcagcaaagataagaagaataaaggggctaagaaaattgagttacaagtagctggtcgctggaatggtatcgactgtgtgattatgatgaaaaaagcggaacagccaaaccatgtagtgatcaagctattatctgatagctcgattaaagagatagcagcggaagagttcaccttaactggctactttgaatacagtcattaaatatgacactatccgctaagcaagaagatcgggggagggggaacccgatctctttaccagaactgcatgcagctacatattatgcaacactgacaaataaagaccgtggaataccaatttctttattcgtgcaaacatgtgcaatgaatcaagacctatcaaaaaaggaagctggaatacgtctcggtaaactggccttcgagttaggatacaggcaattggataaaccggtttactcgaatacgttgtttagctggatgagaaataaaaccactccactgtgggctgcgaaaacagcttggaactatttagaaagccaaaaagtacaacctatgaatgctcttgattggtgttcttgggcgagaacgttcactgattcaggtcgagatatgaatcaagtaccacagttttatgatgtaaatgaagcgagtaaatggcttattgcggccaataaatatcagcaatttagggataaagtcagagaagtaaatcaagagtcatcaaaagagatttttggtaagtattcaaatccagaactggccctaagaacgtattgttttttagctgtctatgatgaccagaacggctttagcagcgtcaatatcgccatatcgattagtgcaaaaagtgcggtttctttgattaccgatgttagcgcggtgttagatgagttatttaaagatgacttgctaatttgttctgaaggggaatataaaattaagaagtctacgaattattttcaataattccattgataaactctaagatccattcgttagctttttgcctggcatgacctagcctttttaagtctgatattttagggtcatgtaaatttatcaagaatattttagtatataaaccggcgatacgttctctataacgttcgtgaagcagactcaatttttcagctacaaaaattctatcgtcaatgtggcacataataggcatagggatatattttaatttctcaatttgagtctttttttcaacttgcgacttagttcgcataaatagcaccttgcagcttttttctgattaagaacaaagatataatttagcataataatattaaagttcagtgtttaccttattaaatatagcattaataattagggatgggaataaagtgaaagaatgtagttggagagaagccatatattcaaaaagttttttaagcatggaaagtagaccgtttaaattgagtgatttcgcagatcaattaataaaaatatttgatcgctcccatcactgttttttatatttattagagtcctcatttcagcataccagatgcctttcggacgcagaccttacagcaatgatggaatacgttcaaaccaagattggggctatgaaaatagagcaatgcttaacaaatttaggtgatgaaaatcatttaaatttaagcgagttaactcatttatctgacgctgctaaggatatctgcaagagccatagtatttgcctggatatctacgttactaggcatcgatattgcgatttttcggagactgaaattgagacagttaaccgatcaaaactgtcactaaaggagaaatcgggtaattatgtgtcaacttataaatataggcacttcaacttaattataaccacagatttaactaaaaatacaactgaaatagatgtctgtgtttcatgataggtcatttctaactgagatgaaaaatacgaatgggtttcgccaaccagttaaacttgatgttttagcacaatattattttaactgatttattggtctatatgcatgagtttcgtctacatctaagttaatttcaccattataaattgtatagttagatttttttaaaagagtttcaaacaatagtttatgattactatctaaggatgatttcttatttttaaatatgattaacaatgtgcaaaaattttcaacagaaaacccaaagtattctactgataattcagtgtcaacaatagatatatagttattatttattacaaaatcactcgatggtgaatgttctttagcccaggttaggaatacctgcacatcctgattagatttaacaagtaatattgaatttttttagttagatcatttatataatacatagcaacctcgtaattaataaattttataaacatataactcattaccattcaaacggtaatgggttttttgttatgttgccaacgtttaccacaatcgccgccacgcgcttgttccgcgcggggacactcccgccacatcgccccctttggtggggggcttactggctggctcggctcatgtggaaaacggtgacaacggcggtttaggtttcgactgttagttttaggtgattttgtgcatgcacaaaatcaagaaggtactcagtgattagtgattggttgccaacgtttaccacaatcgccgccccgcgcttgctccgcacggggacactcccgtcacatcgccctttggtgggggcttactggctggctcggctcatgtggaaaacgacatcggcattggctgctaagcttaaaagtgccttaagctcacacaaaatttcaataccccagccatctaagaacttcttgtgcgtcatagttttctttttctttaagctcagtaaaaaactcagatggatcttcaataccatgctttttgagttctaataatgcttgtttctttgaaatggattcaccttcagcagattcgtagtaagggtctgtaaattcggtattcataatatgttcctatttcgaattagtcgtatatatctggctaactaaatttctatagtgaaaatcctaataattttacatatgtaggtgtagcggcccgcatttaaaatatggcgggcttgcatttatccgcttttttagcccacattaattgcaaatgaaaatactttccggctcatattaactgcaaatgagcttgcatttatcttttttggctcgcatttcatttcgaccggctcacaataactgcaaatgaaattttccgcttaaaccaatctattggattgtatgggtatacccaaaacagacaggacaatgagacaataacaccgcctcataagggtttaaaccagattttcgagacgcactacattcggcatctagatccaaacgagacgattttttcatttgcagttaatttgagcaagcccggcaagctgattgcaagctcattatcacttagcgtgagcccgggagggttttcattgtcacttagcgtgagccgaaaatcgcgctgattgcgagcccacgtaatttcaaacgcgagcccttacacctagcacagcaattgttggcacattgaatcgaatagattcaacatgtgctttttggtcaattccgttagcaagcccacttaccgaaacaagaccttgattagctatagctgaaacaatgtatttcgttaaccaaagtccatcttctgtagcttttctactcccaactatcgcaacggctggttgatgaagagtcgagtagttaccctcgacgaacaaccacatcggtggctcaggtatcttcttcagttgttgaggaaaaagatcttggtcatagaaaaaaatacgaatgttcttcttgatataatggagagcataaaaatctgtggggcactctgttcagtcggcgatagaatgagcaattaagcctatttttctcaggtagctcgccatgaaaacttatatcgtgaaagtggctcttcgggaggtcagtcctatggtctcaggctatcaggcgagacttctttagccgcttttcactctattattcagatcgctcagggatggcaggatgatcaccttcaccagttccgtatttatggcaaaaattacggcatttcctactccggcgggatcggatttcctgacaacccctacaaaattacgctagatgactttgaatttgatgccggtgaccgttttacctacgagtacaactttttcgagcactggcttcacaatatccgtattgaagttattctcggtaattctgacctgaagtctcctttttgtttggccggaaacagaatgcccggggcgacgttagccgggcataaaattaggtgacgatacggagcattattggacagaaacggttgctgcataaatgccccaaggttttttttatgctttcctattaaaatggtttggtcggcagatatttgccgtcgagtgtgattactgcacgctcaccaccttccggatcggcaacctttttcacgtccagtttgaaattgatggcactgatgatgccgtcgccaaacttttcatgtaccagcactttcaacgtggtgccgtaaatctgcagcatttcgtagaaacgatacatggtcggatcggtgggaatgcgatcttcaatgctgccacgaacagggaatagtttcaagtaacatgccggcatccctgcgaagatccagctttttgccaacaattttaacccccttcgccgaaagtgcatgttgtcttaggagtgcggcggtgacgaaggcttccgataaaccagtgccgtcggcaatttgggcgaacgagagatctttcttcgttttgactgaccagattttgtcggcgagcgccaggcggacttcgcggttaacttgtgactgaatcatggtaatacctcatttgtttacagttgaaattaatatcagacggcgatgacggccgaacaggtactgcacggacatcagggttgtcagccaccgaagccgagacccaccggattacggacggtagtcatcagcattgcaaatcacaaacagatcgctgggttcacgttggtcgccaggttcggaaccggagataaacaacgttcgcgggctttgctgtgtagccaagcttctgaacagctcaacgcgctcagggaaagtatcactctgaaatttcagaaagccgtcaataacttttttcattgtgaatcttctgtctctctgtgggatgcggtgaagattactccccatattccataaggtaaaagtctcgtttatgatgggtattatctgaaaatcttatggatgattgtcatgaatttccgttatatcaggtattttctcgccgtcgcagaacatcatggttttacccgagcggcaacagcgctgcatgtatcgcaaccagccctgtcacagcaggtcaggcttctggaagaaagcctcggcgtacagctgtttgaccgcagcggacgcaatacccgtctgactgatgccggagaagtttatttacagtatgtttaccgtgcatttcaggaactggatgaaggtaaacgggccattcatgatgtggaggatctcagcagaggttcgttgcgtgttgctgtcacgcccacctttaccacctattttatcgggcctctggttgccgaattttatacgcgttatcctcatatcacactacaaatccaggaaatgtcccaggagaggatagaagagcggttaattaacgatgatctggatataggcattgcctttgatggcggggaatccccgggaattgcatcaagaatcctgctgactgaaaccctttctcttattgtagcctaccaccatccgcgggcacagcagcgcaaaatcgctctgaatgaactcaacgatgaaaaactcatcctgctgagcgcagggtttgctacccgtgaacagattaatcgctatttttgtgaggcaggtctgcgcccgcaagtgcagatggagttcacctccatcagcgccgttttagacgtgatccgcaggacatcactttcaaccttgctcccagcggcgattgccatgcagaataatgacttggtagcgatcccgcttgctgactggcaactggaaagaacgggggtgttgatgcagcgaaaaggggcatggcaaacaacggcagcgcgggtgtttattgaagttgcacaggcgttgggtcatgtattaaatagttagttgttatgataatcctccggtatttcgtggtggaacatggctaaagtagtagagcataaaaaagtctgggcacttatgcagcaatagcttcagcttctgtcaaatagcgctcggtttcttcacctaactttattcccggataccaatgctcaaatcgggcttttaaatcattattaagtaccgctgtgcgtgtctggagtaaataatgtgcgccttgttggctccattgcatttgctgctttttcaccatccgtttagcgataacttcattgattgccgattcaacaaatgacgaggagatcggttcgccatatcggtacatttcaccataattcgggatcatcatgctgttattttcaatataggtatacatttcatcaagatgttttaacagcgatttatggttttcataatgcaatgtatcgtcatcacatatcaaggcacaatgatccaaatattctaatgccttatcgacattcccatgccagatagaccattttgtgctggttaaaacgtctaataattctgcaccgagttcaggggcgttttttgatacccctttggcatattgttttaatactgtcagacgcattgtgatatgaaaccagtcgagtacatgctgggattcggggtacaaattaaattgcagatccctgagattatcagcgccatccgataagaaggtaatttgttgattagcctgcatcccctgtgaggataactgagccaaaagttttcttctggggtgattttccagacactgcacaaaaccaaagcgtttggccggaaccgtcgcagagaacgattttccggcgatgatttcaaaatggtgttttctatcgtcccggtttctgacgtaccccccatcaatacccaccgccatcggttttcccggtttgggtaatttttcccattctctgggatcgccagggagaaaatcaggcaacccatctaattcggcctcttgtcttttagccgtctggcagaggtggtttctgactgtggcggcattacagcgttcacccaccggcaaaatatctttgagcagattggcggtcaatccataagacatcaatgaagcccatcgggtttctatatacctgagttccgggtgagtatgcgtatcacaccagttattgagcaagctaacggtgtgggttgaatgtttttcacaagcacaccggtaaacccgaaatccctccacggggataatgccaaacaaggttcgatacaggattgtctgtttaccttttatccgtcgatttcgttgacaatgagggcaagcgcgatgttcactcaggtattcggccgcctgtttctggatcaccgattgctggatagcgttcaaaagcaatttggactcagacagggaaagcccaatgtcattgggggtatcactctgtttttctaccctaaatagagtttcagtatggctgtgacctgattcatcggccaccgctatttgaattgtgaattgcatgatgttgtcctcctggggttgtggctactgtattcctccattttttagctggtgacgcaatttataatacgtagaaacacctaatcctacgttatcgcaggccagctttaacttgataccttttgctctcaacgcgtctattgggggtaatttactgatatccgcaggcggcctgcccgttcgttccccgcgctgtttttttgctgcgatcccttcggtttgcctctctcgaatgagtgcccgttcaaactgactgaaggccgacatcatatgcagttgcagctcttgcatgggtgtgcactcattagcattaaaagaaagctgttccttcaggaatatcagtgtaataccttgctgacgtaaacgcagggtcaggctacacatatccatcatattgcggcataaccgatcgatggagtgaacaacaatcgtgtcgccggttctgacctgttgaagcatatcctgaagttgtggccggttgatgtttttcgcactggcctgttcgacatacattttgtcaatttcaataccggacgcaaacagcgcctctttctggcgctcaacatgttggtcaaccgaactgacccgaatgtaggcataatgcatgtcaccctcaaaagtctttaaacctgataaagatttgtagaatactctataaaattgactttttcgaggtttatagagtgttatggtcttgttttcagcacagctgaaaggtatacttttatagaatccagtctaagccttgcgagtaatttggtgtataaaaatcataatcctttaataaccggttgagtcgatggcgattaaatttgacgcgattgaactcgtcgatgaattcttggatgtcgccaaacgttgtactgtcatcactttcgacaatggcttccaatagcttcaatgtcgcttcgatttcatcatattgagtgacatcaggcataccttgcccactgagacaaaatggcgtacttttatttgagtcaggttcaatcgcttcgatgcggatatccagtaacccatgccgatagaaattatactcataagtgaatttatcacggttttcgaaatgaaaagacgcaagtgaaacagcccagggatcattataaaaactgagaccaccttcatagctgataccatagtctttaccgtagatatgaaaggtatggagatagtcattatcccaaccaaaagcaaattgcagtaaaaaatgaaaagcgcctagtgacatatcactctgaatgcgaaaacgtcgccagatcatagggctgacatctcgaatggcggcttttactgtatatacgggcataatttccctttcaccatgatgataaagcgaacaatcatacttatcagggaatctgagcgagtagagctattggttatccgatcagcacctcaccagaacttgatttgcaagactaccgcttccggctctcacataagtgccccacagatttttatgctctccaaaaagcacatccgggtcagcaagatgtcatcatccggtacgatccgtaagcattctttttcctcgctggtcagtatttgtcgccgtggcataaatattctccttacatacggattcagctcacttacctattcaaattttatccctcagagtcatgtgttcagtttaactatacgtataaccgttcgttctgagacaccacaccaggggttacgcatgaaattttggtaggctaaaattgattaaataacagcgcttccatataacacttatcccacccggctgatttccttcgggcactcaaactcagtttactgtttatatctcgtttaacgatattgagcgccattttacgtaattgagcaaatattcttgtggcgatccgctctctcatccgtgaatcatcttctcgaaaagtgacatccagtacccagtgtaaactattttcgatagcccaatgttttcgtatggcacctaactgaaaggcgggaacatcctgacaactgattaaataataacgaaaatcagaggtgactgtgtcagaatattgttcttgccgtatcgtttccgttacaaggagggcctgaatatccggccaagaacctaagtgttttgtttctgatgtcagtggcaaaacccatccgcgtcgtctgactgtacgtccgtggctatcttcaaattcatcatggtcaggtttaagatgaggctgttgggttatctgttactgaaaatagtcaacggcttccgaaaaggtttttccctgattgcctttaagggacaaaatataatcggcttcactctcgcgtaattgctaaacaattgtgcgttggcagcccatcgcatcaatcgtcacgagatgcaaatattttcatgcgtaacccctggaagttgcccctgtcacaaaaacaatcataattatcctcttatctgcgagtcattatcattaataaccctattagtagaaaaatttatttcttattagtcaaggttaaattgtttttcatgctattaatactttgtttttaaataaattatttatcaagtgacatgaggataaatatacaatagaaagacttgattaaaataaataactggaataaattatttacaatgaaatcatatatagagtgctaaaattttttatagataaaagtaaaaaatcaggagtaaatatgcctttttttcaaccatttaaaacgagtcttgagccagaggatcttgtatttggtttaaatacagaaagaaacaagtatgccatagaatatcgagccttcggccatttacgcgataagaatcatttctcaataattgatagatattcaattactccagaagaaattacaacgcggaaatttcttagagcacaaatcccacctaatcaagaaagctttacacaatcgatagaaaatcatcgtaagtacaaggtattacagtctgctgcgaaagataatggaaagacgaattttgatgttgattgggataaacattgtctttcctatactaaaaaagtgacaaaaagaaaatgcaaagctggattatcttggtactctctttcactaaaccgttcatgtattcattttattttagatggaatagatatggagagtgttatttacaaacattatgagcaaaagataaagaaagggacttcatacacaggcagtgaactgagatggatatatcgaaataggaaagatccaaaagttaaatcttgcatccaattttggcgaaatggtcagccagttctcccaccttgggaagaaggaaaagatgctcatttatggcaatactaccagccgaaatttgaaaactctgaaattgaggttggggaatttgctgaaaccgttttgaacctttaggataaatataatggtcagctaaatgtaagtcttgatacgacgagacgcactgaatgacaataactcgattgagcaagaaatggcccattaatttttttgatagaccttttcttgcctgattacagcgttcttagattctgattggttttctcgtcagaactttcatgaatgcttgtacaaagacagtagtatagaataagggaacgtatagcattccaatggcgatcatcatagctcctatagaaagcattatcgcaactgtgctatcaggtgaggttatattcattaaaccttctgataatcccactagaaattcttttccttgtagttttgcataaagccatgaagcgccaacaagaactgttcctaaccaaaatgagatccagcatattgcggatgtaaaaggggttgagttgtttctcatttttttcctttatatttataaaattacagatgatgaaaagaaacattagtactgaactgcatttctttttgcgaaagtttagattttttcatgttgatacacattttgccaatataccaaatgataagtggataataactttgatttgaccaaaataagtaaccccagtgaccatcggcagtcatccattttctgagcatttccaccgagacgatgatgtcgtgacgttccctaagtttttcagcagccagtgtggggccaaagtcactgtaattttcatatagcaacgccaatacctgaagttttagcgattcaggaagactgtagttgccagatttgcatgtcaaggctaagtagaaatgtcctgatttatgcatgtattataaataattacaggcggttctctggaggagaacatgcagattaatatgagaaaatcatactaatgaaagctatatctatagtcgcaccagcaggtgaaaatattgcgacaggaaaaaaaacgttagaaataagaaaatgggcaccaaactttgattgtaatgaggacttgttgattgttgagaaccaacattatcttttaaaagagggtgatgaggaaatggggaaagccgtcgcaatcgtcaaagttaaaaatgttaggccattttttgaaagtgatattgaagcagcttgcgcatcgtattacgaagcgggttggttagcttgggagctaacggatgtcagagctatcgaagaaccaataaaaatgatagcaaaacgtaaaatttatgaggttgagctgagagcctaacgattataaaccagccagaacactgaattgcactttcatacctcattatgatgaaaataaaaagttaagatgactaatcggaaattatctcatggatttgtttattgaaaaggttacacctaacacagttggtttttgggagttgatgaaagagtattcgtttttaatacaatatgttacgcaggctgaaacataactggcacagcggaaaaaaccgctttgagctgccgcccagtcgcatcatcaataaagaccagtaaacagcatttaggcgctcgtccctcgaaccagtcatgaggagaaccgtcaatttggatcagttcaccaaaacaatcacgacggttacgcggctgatatatacggggtttacgtctgacatagggaacccagagaccgtcagctatcatccactttctgagcaggggttacgcatgaaattttagtaggctaaaattgattaaataacagcgcttccatatagccattatcccacccggccgatttccttcgggcacttaaactcagtttactgttggtatctcgtttaacaatattgagtgccattttacgtaattgggcaaatactcttgtggcgatccgctctctcatccgtgagtcatcttctcgaaaagtgacatccagtacccaatgtaaactattctctatagcccaatgttttcttatggcacctagttgaaaggtgggagaatcatggcaactacttaaataataacgaaaatcagaggtcaccgtgtcagagtagtgttcttgccgtatcgtttccgttaccagaagggcctgaatatttggccaagaacttaggtattttgtttctgatgtcagcggcagaacccatccacgtccatgactatcatcgaattcatcatagtcaggtttaaggtaaggtttttgggttatctgttgctgttgaaaataattaacagcttccgaaaaagtttttccctgattgcctttaagcgacaaaatataatcggcttcactctcacgtaattgctgagcaatcgtgcgttggcagcccatcgcatcaatcgtcacgagatgtcctttcaatgaaagcatcgataataatgcggggatggccttaatttcgtttgattttccgtctactgcacactgacataagctgagtcctttctcaaccgagaatgcactcaccacatgtagtgggctttgttcaattttcttatcaaacgaatggcgtaaacttttaccctcaatcgcaatgatcgctcgcttttctgaagagacgtcacgagaaatccactgataaaaatgacgttcaaagaggccgggatttaataaactaaaacagcgccggaaagtatcatgtgacggaataccgcctttgagcagaagaaatgaacccagccaatccttttttagctggccatactgttcaatatcggtccaggcgttagccccggcaatgacagcgcataccgcgatcactaagatatcaataaaacggtgtttaacctttccctgacaacgtggatctggaaaatcagaaaagacctccactaattctttcatctgcacccctctaaaaatgaaggcattatccactaaatattttcatgcgtaacccctggacaccacacaatctcgcggtatctcggatgctctgcctgtttttaactcgaagttcaatgattttctcatgcagctggttatctgcttggcgtccccggaatttaccagcggctttggctttcaatattccctcttcctgacgccgccgacgatcctgatagtctttacgtgcaatggctgccagcatatcaagcatcattccgttaatcgctttaagcatggccagagtgaactcatcacccgcattttctgcaagcgccatatggctcgtcggcagatcaagactgacaatcacgaggtgtttttcctgaataagttgtttaagtttctgccagcccgcttcatccagacgtgaaaggcggtcaacctgctcaataagaataatgtcacccggtgcagcatcatcaagcaatcgtaaaagttctggccgttgcagtgacgcgccggatgctttagcccgcgcaataccagcatgagtacgctcgagtaacagatcacgctcaaactcggctactgcagagataacttgcatcgtcatttttccagcaggacttgtcaggtcaactcctcctaatgccaggcagtgaacgcggatttctgagtctacgagtaactcaaccgttttcctgatatccatggcgttacgtcctaagcggtcaagtttcgtgacaatcagcacgtctccgttttccatacggtcaagcagccgtgtgaatcccggtcgctcacccgccgcaacagatccgcttacatattcttcaatcagtcgctgaggtctgatagcaaatccagccgcctcgatttcacgacgctggctttctgtattctgtttgtcattttcagaaggcgactgcaccaattgatagggcttaaagcctagtgtgcatatgacttctgataaaataatttcagaagtcatatgcactaaacactattatgctcggtattcatgtgcaccaagacgcagaactacgctggatgattggtaacatagctccagcaatcgagtgcagacgacttctgacattccgtgcaatcgtcttctgaaaatgacagtcaatatggattgtaatgttcagctttttaccctccttaaaaaacaccaggataggcaccgccatcaataaggatgttttgccccgttatataacctgcatatacactacacaaaaaagcacaatatgctccaaattcttcgggggttccaaaccgtccagcgggaattttttggcggcgctgcattgctatgcgctccggtaaatctccgcatctcgacgctttttgtgcaaatgtttgcttcaggcgattagtatcgaaagcaccaggtaataaattgtttatggtgacattattactcgctagagagtcagtttttgccaagccacagataaaaccagttagccctcctcgtgctccatttgataatcccaactcactttggggggctttaactgtaccggaagtaatattgataactcgtccaaaacggcggttaaccatctcatcaataacaatctgaatcaggctgatgggagtgagcatattggtattaattgcttggtaccatatgtcacggttccaatcggaataattacctgtaggtggtccagccgcatttgtaacaaggatatctaccataggtgatgcacttaacacagtatcctgagtttgtgattctgttatatcaccaggtacccattttatcgatacagcagggtttatattttgcagccgccgcgcagccgccttcaatggttcaggccttcgagcgttaataacaacatttacgccttctgcaactagtgcagcagcacaagaaaaccccaaaccttcgctggctgcacatataacagcccaacgatcggctattccaagatccatattttctccgttagtatgaaagtgaaggtaacggtttcaatttcggctgtgttataagtgtcaacgttctattttggtgctttgtactgagtaaaagcgattaaaacaacacaaattagagtaaggatgaaaagtccccacattaaccctgccgcagttgctgtatgcccacgggagaaaaaatataatacaatggcggcaccggccatttttagtgctccttgtaaggcactgcctgttccggataattcaggatgcccatgtaaacttatcccgagtagtaatggggaagaaaacccacaccccattccgactgaaaaactataaataacgataaatgcaattgataatatctgtatgaagtgaacagaaatgagcgcaattgcagtgaagaaaagtaataacggaagagaaaccctaagaattttttcagggctagagtgtgacaaccatttctttgtgagtaatgagcctattacaattccagcagaataaatcataaacagatatccattctgtgacgaggataaatcaaactgagtctgaaagacgaaaggactggcagtaaaataaccaatggtaatggcaaacaaaacggcagatacaacactgtatacaacaaaactaacatcagataacagaattcgaaaacctgttatcctgccactgtctgttggtttcatcggcgatgtttctggcagcgtcatttttacaaaagatacccctaccagcatcattatggcgagggctataaaattaaacctccacggcagatactctgtgatatatccaccaataacaggagcaaaagcaggtgaaacctgtgatgccatcgaaaaaatagtcagtgatttggataattcggttttatcacggaaagtatcactgagtatagctctgctaataactggacacccgcctgcaccaataccggtcagaagccggaacagtgacagtgtgtgaaatgattcagctgtagaagtcaggtagttaccggcggcggaaaataataaggaaaatacaattatagggatacgcccgtatttgtcggaaagtgggccataaaaaagctgagatacagcaaaaccagaaagataataaacaacaagactttgcgcctgattgttagtaatcgccagtgctgattttattataggcagtgctggattatagagatctatagaaaataatcctaataccagtattacgcacgaattgatgatgattagtttggacttcatacctttttacccttcataagagtggaagagtttttatgcgcttgttgtattccttgtttggtgtggcatgttgcttatcgcatttgatctcgatcaaaaacgggctgttctgttgcataatttcggcaatatgcttttgtaattgctcaggagaattcacacacaggctgtttaatcccaatcctttagctaattggcaccaatcataatcagggatttgagtcagatctgttctgttatctttattattaaagtagcttgctgcataagatgtgttattaaagacaacaaaaagtatattgcgctggtattttgatgcagtggctaactccattccttgcattagcatacaaccgtcaccggttatgaccatacattttctgtcaggggcggcgaaactcgctcctatgccagcagggatgctccatcccatagggccaagtgtggttgctgatatatacgtctcaggcctgtgagcgatccaataatgaccgaagaatgaacgatgtgcaccagaatcaacactgactattccattttcaggaaaatgttcctgaaagattttgatataggacgcggggtgtctggtttcattacctgttgcactaaaatcgattgggaaatacttgggaactgtactgaggtgttgtacccatttctcccgttccgggcgtccttcgatgaggggattatggtagtattcattaagagtttccagaaatgcgctactgtttgccgtgatcccacaagtgatctcaaggtatttacccagatattccgggttagtatcgacctgaatcgttcccccaggaagttgcaactccagagaccatagcatggtgctccattgggtggtgtccattcccagtaaaataatcccttccaacttcggattcttaaatgcttcaatggctctggggttacttgaataaccgtaaataccgagtgacagaggatgggattcaggaaaaagccctttaccacttagagtcgttgccactgggaaatgatacttttctgcaaatgctaacaacgtatcagctgtttcaggcattttgccccgtagccccgcaaggatgatgcaattacgggccttagcaatgaaagttgcaaattcaggtgaatttattttcttgatatctatcgggcgattcttccaagagtcagcaatacttgcactgatgtcgggacggttttcatcatgttcatttaaaacttcctgacttatccccagataaacggggcctttttcagtgcctttcattgcacggagtgattccctcagaaaacgactgagtggttgacccgccttaacgtcaaatgctgcacgagtaaccggagcaaaaatttcacgctgattaattccggattgggtactgtcctgtaagacattgtgcatttccattgctgaagcaatttggccggctaagagtaaaacagggaaattatcagtataggcggaggctatacccgtcagggtatttgtaacacccggccctccaataacgagacatacaccaaaagtgtcagagacacggacccctcagccatataagcagcacccgtctcgcaggctgttattatcggtataggaaagatgtccaacactgagtcatcatcttttggatagcatttcatgaatgaattaatgagcttgccgggtaccatgaagatatgagatgcattcaagtggcgcagctgctttagtatataagatgccccattttctttatatccattatctgaatgcgccatagcttataaccctatgaattgtatattgtattgtttcattatgtttaatgaatcctgatgaaatgaatctggataccggacgttgggcatatctgcaaaataaggttttggacttttaagcaggtaatctgaaacatgcatagaacattgcgcacgatcttgaagatactgtagatatgactcgttatgccgttctgaggcagatactgtccattgtaaagccagtttagtgttatcaggtgctttatccgggtaagtgcttctgtgagttattctgttatcccatagaataagatcaccagccttactcatgataactttctcgtatgcctgtggcgtatttaacatacttttcacggtgggttgatccagtcgatgagagaagggtatcagagttatcccacctcccagttcagggtcattgtcctgcaaatagatagcacactgcataaactgtagtggaacttcaggattgatgacttcatcagggagaaaatatgcgtcattatgccagggaatatagacactttctcggatagtaaaattgggaaacaaagagaaatctcgactaaaaagttccctgatagcggtgactactttatcttttagaatagtgttaaagacatcgggggattttagtacatccgtcggaagcagtgttgacaaattatttctttctaaaattttcttataatattctctaatgatgtcaatttcttttttatttattacttctgaaattacaacgtaaccttgttcactcatctgtttgataatattcatactgatatcctccggataattaaaaatgaaattaaactaactatttcaaaaatattaattttattttccatgttgaggaataacctcttgaaatgtgatccccaattgttcaaattctttaaagaaatcaggaaatgaacaatgaacatcttcataaccatcaatataattagcttgttggcaacgtaatgatgctacaaataaagacataaagatacgatgatccccccagctggaaagtatgcaattccccgcgtaggatgaagctccataaatttctaaaccatcataaacaccatttataaatagaggacgaatattgacacccaattttagtaattcatttaccattgcctctattctaggcgatttatgaaagcgggtaatagagcctccggtaactctgaaacagcctgcgacataaatacctaacgcagcaagagtaggtacaatattagggcagtcgctgacattaaattcataatttccagtcagttgtttttttttatttatcaggcgaatttcgtttcgcttataattgcgaatgatatccattcccatttcatcaacaaacgttagaatcgcttgttcgccttgtaaactcttactattgatattcttgagtgttaaatcgcatggaaaaagagttgccgcagcaacaagataggaacatgaggtgtaatcgcccgttattgtatattcagcagaattatattgacccggaaatacagtaatttgggaaagattctcattttgctgaaatttaatgccagctattgtcagagtttctaatgtttgccgaatgtatgatagcgatagggttttttctatgattttaatcgtggtacttttcctcgcaaggggggctgcaaacagaattgctgtgataaattgggaactgatgtttccctcgatttcacatataccgccagaatatcctccccaattgatgaaaggggcttttccattcatatggacactggaaatgtttcctcccagctgaataagagcattcagtaaaggttccatggcacgggttctgagaacgacgtcaccagagatcaccgctggagctgtactgtggcaggttagagcggtcattacacggaagactaaccccgaacccaaagcatcaatgacttttttcttcggattaatttttccgccgataccataaataattaaccgctcaggctcctcaataattcgggcaccaatactgcgacaggcttccttcattgtgctggtttccagacaacgtagatcattatttataactgatttaccattagctaagctggcggccagaatggctctttgggtttctggtttcgatgatggtatatatacccatcgtaattgaagatgcttgatttttcattcgtatcagatcaagatcgcgcccatgaaaattacgctgacagatgcccaaaaagaagccctcgaattgatgcacgatacgactcgtgatgggcgcgtacgtgaccgcatcaaggccgtgcttttggcctcagaaggttggactgctcagatgattgcccaggctttgcgtattcatgaaagtacggtgagtcggcatctgaaggatgacttctctgaggaaaaactcgcccctgaaaatggcggctctgaaagccgtttgtctgccgaacaaacgacagaattagtggagtatctgacggcaaatttgatgcacactaccgcgcaaattgttgcttatgtctgggcgcactggcaggtgacttacactgtggccgggatgacaaaatggctccaccgccaagggttcagctacaagaagccgaggggaattccccataaatccgatgcggataaacagcaacactttattgagacctacaacgcgttgaaagctgaatgtggtcaaaatgcgcctattttgtttattgatgccatgcatcctacccagtccacaaaattaagttacggctgaatgaggcgcggaagggagcatgtcaacgtggtcgaaaccacaggcagccggacccgccttaacatcatgggcgccctcaatttgattgaagagaccattattcgtgaatatccgacgattaacgcgaaaaatgttgttctgtttttcggcgcaatccgggaaacctatccgctttcacaaaaaattcatctcattctggatggcgccggttaccaccgctctgaaatagttcaattttttgccgaggtcctaaatatcgagttgcactatctgcccccttacagccctaacctcaacccgattgagcgattatggaagtatgcgaatgagcaggtgcgaaacaatatctattttccggatgcaaaaacgttccgtgaaacgctgcatcacttttttcatgtcacattgccagaaaaagtgaaagaactcaccacccggttgacagataatttccagactttaagtcctgcatcttcaagttaattgcgtatacattccaacctaaaaaaccgagcttgaatctacgggataatgaaatcgctatctttaaacgaagctgaggttaattaatttattcggcatctttctaacaaaaagccgaatatcaatgtattgccccaaaaatttaacaacattcataacggcttgttatcttattccatttccatttatcatttcttgctgcgggatgtaattccatgcccccatttatgttcataaaccccatatttatatatgcttgcctcgcctcatcataggagaaagttttaactttccttccatccctaattgttgtgatttatttactgcatattcaatgagtaaaacaccacaacctcgaataccgcaatgagtggccaaaaaagaaacttcaggtaactcattttcatgattatcttgcactaataattgtaaggcaccgacaggaatacctctgaaataagcaacagcaaaaaacttttttgaaccgtcagttttatctctcatagattgaatctttgcattagtcgagagacaattaagtatactaaccgcctgattatacctcattttccacctttcctgttccttatcaagcttaagaaaatcaaaataaaaccaatcctcagccatagtttctgttagcatcttttccgttgcgtagaatgcttcttctgggctgacctccttgattgtgataaatgttttcatattaaccaatgttgtgtacatatccgtacaggatttagaccgagttaaaggaccaaatcctacagaacggttgttaatattaaaagattttgatctgaacattacattaattcccctcattatattttggaaggtgtaaataattcacctgacttttctctaacaaaaatccaaatatattacaacgtattaggtgtccagactgatatttaacagaatctataacgacccgttgcctcattccatttccatttatcatttctatcagcaggatataattccaggtgttccccagccccagtaaatcccattgccatatatgtcgctctcgctccctcatatggagaaagttgtaactttcctcccattcctaattgttgtgatttatttactgcatattcaatgagtaaagcaccacaacctcggatgccacaatgagttgccaaaaaaacgactttaggtaacccatcagtaattaataattgtaaaactccgacaggaacacctctgaaataagcaacaaaaaacaacactcttttatcaatttcttctaatttaaggcgaataccaatatcaatatagaaaaatttaaatattcccaatgcctgattatatctagaattccattttatttgctcctcatcaagctgaccagaagaattagggcacaaccactcattattcatagtttctttctttattttttccgttgcatgaaatacttctgatagactagcctccttgataactatagaacatctgatatcaattgatcttggccatatttctgaaaaagattttgatctgaatatcatattaccctccttatgatataaaagaattgggataattaaataattttatagttttcaatgctgactgatataaaaactcatctatacccatcgtaattgaagatgcttgatttttcattcgtatcagatcaagatcgcgcccatgaaaattacgctgacagatgcccaaaaagaagccctcgaattgatgcacgatacgactcgtgatgggcgcgtacgtgaccgcatcaaggccgtgcttttggcctcagaaggttggactgctcagatgattgcccaggctttgcgtattcatgaaagtacggtgagtcggcatctgaaggatgacttctctgaggaaaaactcgcccctgaaaatggcggctctgaaagccgtttgtctgccgaacaaacgacagaattagtggagtatctgacggcaaatttgatgcacactaccgcgcaaattgttgcttatgtctgggcgcactggcaggtgacttacactgtggccgggatgacaaaatggctccaccgccaagggttcagctacaagaagccgaggggaattccccataaatccgatgcggataaacagcaacactttattgagacctacaacgcgttgaaagctgaatgtggtcaaaatgcgcctattttgtttattgatgccatgcatcctacccagtccacaaaattaagttacggctggatgaggcgcggaagggagcatgtcaacgtggtcgaaaccacaggcagccggacccgccttaacatcatgggcgccctcaatttgattgaagagaccattattcgtgaatatccgacgattaacgcgaaaaatgttgttctgtttttcggcgcaatccgagaaacctatccgctttcacaaaaaattcatctcattctggatggcgccggttaccaccgctctgaaatagttcaattttttgccgaggtcctaaatatcgagttgcactatctgccaccttacagccctaacctcaacccgattgagcgattatggaagtatgcgaatgagcaggtgcgaaacaatatctattttccggatgcaaaaacattccgtgaaacgctgcatcacttttttcatgtcacattgccagaaaaagtgaaagaactcaccacccggttgacagataatttccagactttaagtcctgcatcttcaagttaattgcgtatatagttttaatagcattatcaggtaattttattctggcttcgtacatcgatgaagcagagatagaattatattgcggaagtggtattttttcacgaatgcagtcatcccatatttcattgataatataagaatatccatgattattctttcctgatataattttcattaggaaaagaataatcagttttgtatcaattgttctctttcttttttgccaagatttatcaattcttgaacatgaattaaaaaaagttttgtttaggcgttgatagatattcatgattctctcccccatttaaactttatgtttataacataattatttccttaaccgaatgccattggtataccaatgccgtcgagcaaagggatggcggatcgactttcgtgggcttgccccgccgtcaaaagcaggttgaggggaaaaccccgtctgtcggttgccaggtggattttggtgccataaccaccgcgtgagcgacccagcgcatgatcgtcagcgatatcgggatgttttttttcgcgcctgcggcatctttactcgcgcgaatattgctgccatccaggcaaatttcagcccagtcaatcaagcctttttcatccagaatggacagtaaccggttaaatatcttgttgataatgcccgattttgacccgcggttaaatcggttatagaccgttttccaaggaccatagcgttcaggtaaatcacgccacggtgccccagagcacaagacccagaacatcccattcatcacccggcggtgttcaacatgtggacgtcctgcccgctctgaatggaccggaggtaaacaaggttctatcactatccatgcgtcatcaggaatgtcgtagcgtgccatcatctttttcccatattgaaaacagtttagatgagaatactatcaatttacattaagggacacagcctaatgcgacagaacccgttgactagcaaactcatcaaattcactatctggatttgaagattgaggatagtaccacttatacaaaccataggcgggatcatgcctcaactgtctctcctcctcctctgaataatagtgaccacctctatctgtcttatcaataaaatgacggtttatattgggcattgaacgaaattgcatcgttggataaactcgtgtgcctcctaacgagcctttaactggcatattgatatgattagctaatgcttgagcaagcccatttgctccagagtggcaagctattattctgacacattggatattttgccctctattttttatatcagttaataatgcattgattgtttgacaaaaaacattcaaattcattccaaaattatacgcacatgctcccgcaaataatattggactgcccactggagatgcgtgtcctataatattgagccgacctcccggtttatgttttggtgtatctaaaaaataatgaaatcgcttctcctgatgaaaactcacctcaaccgttttctgcagcaacacatcactaggcattgctataatattggagattgtgtgtcgatattgtcccataactccccctacattaaattcagcttttaatatatgtcttggattcgcctaataagtgcaatttctaagaaaggcggtcagttgctatagtaggcatctttctcgccaaaggaaaatgggttctgtcgcattaacagagaaagtttgtacggaggtgggaatgatgactatttatgcagtcaatcgataaaatatctctgccggtgacaatgtcttatcttctgattgtaagtattgccctttacgccgcatcgaaacgcgctctatccccgctaaaatcgtttgagcccggcgaaacgatttaaaacctaacattggccgtatccgacgtttgacatggcgatggtcttgctcaatgcggttattcaggtatttattttgccggatttcaatcccctgctgaggctcaccttccgcattgaggagggtgagcgcggcggtattggccccactttcatcgatagtcacgacggtgggtctgccgtgctggcgtatcgctttacggaaaaaacgccgggctgccgttgcatcgcggcgagcggtcagcaggaagtcaatcgtctgaccgtcggtattgaccgcccggtaaaggtatttccactggcctttgactttaatgtccgtttcatccattcgccatcgggagccaacgggctttttgcgaggtcggaaagccttgccgagcaggggcaccaaacggaacacccagcgatgtatcgtggcagggtcgaccccaatgccgcgctctgccatcatctcttcgagatggcgcagactcaaggcataagcgaggtacccacgaacacattgaggaatgatatcgacaggataatgcagacgtttgaacgcttttcggatcagggacatcactctggactcgctcaaaaacagggaagcttacctgatgaccagaaccatgtttattaatcctaatctactcagaagacaac

SEQ ID NO: 16911 - DNA, 927 bp, Xenorhabdus bovienii
  unsure (1)..(927): unsure at all n locations
cctttaccttcacccccgatccagccaaggaagaagccaacgagctgccacatagcatcaaggccgaggcaacctggcataacgggatcattgacaaaatggcaatggaagaaccacagctcagaattaatatctaactcagcttcgacatagcctttatcgtaggcacccccggtttctgtcatttttatgatgcgatccatcatcagcatattgccagaaggcagtggtgggccattttcaccgaataacttaccttgtccagaggtttgaagttcttcttttgtataggactcttgtttgttaaacatatttttggatagccttttaattatgtaaggccagaggatagcgtacacttgtacgctgaacaactccgatcagatgatactgaattaacctaaccagcgcagaaaccaaggaagcttaggccgctcttgactattagcctgtgtaatgcgttcgtatataatggctaacaagtgttctttttgtggatcgtaatagggaatacccgtcagaagtgatgctgcttcagagacatgttcaactgtccagatatgaaattgcccattttttactgcgtcaataatgtcttgattcagacacaggtgttgcacattggacgttgggataatcacgccttgcttacctgtcagctcccggtagttacacaaacggaagaaacttncaattttttcattgacgccaccaatgggttgaacatagccaaattggtctacagcccctgttacggcaatttgctgatcaataggctgttgtgacagggcgctgattaacgcacataattcagcagtgaggcgctgtcgccatcaacttcgccataaattggtccaaccacataaaaccaaaaaacggtgggggctgatccaggttttattcaagattaagtaaacccgcctgatn

SEQ ID NO: 16912 - DNA, 1569 bp, Xenorhabdus bovienii
  unsure (1)..(1569): unsure at all n locations
nnnnnnnnnnnnnnnnnnnnnngtctacagcccctgttacggcaatttgctgatcataggctgttgtgacagggcgctgattaacgcacataattcagccagtgaggcgctgtcgccatcaacttcgccataagattgttcaaacacaatagaagcagagaacggttgtggctgatccagttttaattcagaaattaagtaagcctgcatgatcatcatgccttttgcatgaatattgccgcctagctctactttacgttccacatcaataaattcaccgtctcctaaatgagcaacacaactgatgcgtgaaggttcgcccatcggatctggatgccctgggtattcgagcacggataacccattgatttggccaatcactgagccttgtgtacggatcagtatctgacctttcagaatttcgtctatgctacgttcagccaaatagccatgacgccagagacgattgtcttccgcttgttgcatcgaatgcgatgtgatttgattttcctgttggtaagcggcggctgtttccagcttttgttgtaaccactgaatatccaaaggtaagctgagttggtcttcagtataacgaacggcttgcttgagcagttcaggccatgcatcagtacttaatggaggcaatgtttgctgctgaattattctgttaacatagcggcaccatagcgctagatcatcttcttcatgaaatggcatatccaactcaaattcgccatacagtgcattgttggccaattctggctcaagagcgtgtaattcctcaagactcaggcgatctcctaccagaacgagccgcaaattcaacggcattgaaggtacaggaaggggtagtgagcgattctcattgtgtgatagccaatcaaaacggcgctggataatcatctgcttgagacgaacccacattaatggctgagaaagtagggtacgtaaaggcaaaatcaggacaccgccattgacctgatggataagaccaggttgtagctgaagcgcaccttgatgggtgtagatgttgccgaataattgctccggttcaatccattcgcgataagcaacccgctcagttggtgcaaaggagccttcaccagaagaacgccaagtaatggtttggtgttctatctgatagtaaccaccgattttgggacggctttccggcagtaaagctgagatagtatcagataaatgagacagataaatatcactctcatcagcctttaataacataaaaggctgacgcagatcggcctgacaaaagagggttagcccattgtgtaacctagattgaattgcatccatagtgacgggtgccaattcagcgacagaattgaagagtgcttgataaggcgtactgtttagctgtaatgcctgccagtctaattttatattcgtcaaagtgatagctacatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16913 - DNA, 871 bp, Xenorhabdus bovienii
  unsure (1)..(871): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaagaaagtaggataattcaaggtttaccgtgcggggtgcaactgtttcgacacgcttagttcttgaaagcttcccagatagcctttgctctctgtatttggaaaacagttgtgcagtgaattcgatagcaagtggatcacccatgcactcgcttgcccaaagcatcgttgttcgtcgccttgctccgtcgcctaacgtaacgccatgtgctttataccaaatttcgactaaatcacgtaatctacgggtgtctttggcattgctttctatccacggtttgccattgagtttatctaactcatagcgttcgtaagctaatgcctctccttttgtggcgaatttcttgcggatgcgctttccctttttgccatcagagcgatcttctgcgtagaaatcagcaatccattctccggtattcctgaaatacgccgtactcaggttcttggctgctcccgctgtgtggattgtcaggctgattttgaattaattaaaaaacattaccggagtatatgagatggctagatggtgtcgtcataagacatttaaccaaagagcaagacagcggatctgaacagtagcaagaaatgaggcactatttttggcataacgggtcgctataccccgccagcgtttaagatgaagaaaagcattttcaactaaatgcctnnnnnnnnnnnnnnnnnnnnnnnnnnnnnnnnnnnnnnnnnnnnnnnnn

SEQ ID NO: 16914 - DNA, 103795 bp, Xenorhabdus bovienii
  unsure (1)..(103795): unsure at all n locations
atgaaacagacgattcgggcgcggcgtaaacgtcattttaatgcggaacatcaacattcgcgaaaaaaatccatcgatttggatttccaagtttggcagcggctttcagctctttcccgacgtcgtggcaatactttatcagaaacgatagtgcaattgctggaagatgcagaatatagagaaaaatatacccatcaaatgtcgagcctaaagcaggatttggaagctatcttggggaaataagagccatagacagaaacaataaaaccccattttaacatggggtttttaattaaatatggagggcagtatgacgattactgtgctgctttcggctgagtaacgatttctttagtaccctgaatattgataactacacggcggtctggagccagacagtcgatgagtttagcgcgacctttgatgttatcgcatgtagagccagtgacagagccttctttgccacggccttctgcttggatgctggctactgggatgcctttagctaccagataatcaacaacggattgagctcgtttctgggataatggcaagttatactgctggctaccgatgcgatcagtgtggccaattaccagaactctgccttgatctggatcaattttggccagttgggtgtagaggttgtctaactcttgtttaccttctgttttcaacgttgatttgttgaagttgaacagaacgtcagagcgcagagtaaagctcttgttttcaacagttggtgaaggcgcaggcgttggagctggaataacgggagcagcaggtacaacgacaggagctatgtcatcttgaccgaaacgataagaaacaccaacgcttagcatgccgttatctggacgggcaccgacactggttgcatcgccgatgttgttgacccactggtaatccaggcgggttgccagatctttggtcagggcgtattcaacaccaatggcagccagcggagaaacacctgtgtcgtggtttttcagtctgcgctgatctttatcacctgcaccacctaatgcgttaacattataagtagcggaagagtctgcgcgccataccataccacctaggcgagtatagacatccagattatccataactgggtagctcagtttagccgccagttgaacgccttgagcacggaaagcaccgttgttgacgctgcctttatatgccatgcgacccagccagtcataacccaattcaaaacctagatatgggtttgcctgataaccgacataggcacctgcacccagctggtttttgcgagtagggccgttaccgatttggttatcgtatccattgccgtaaaaatttacgtcatggtactgagaccaacccagcttagcaccagtataccaagtgttatcctttggagctgcttgagcaacagttgcgaaagctgccactgccactgctactgcgatagctgtctttttcattttacgcctcgttatcatccaaataggcaattggccttaaaagccttattattagccattggttaaaatgtctagttaggtatttgtacttctatcactagatgtgtcctgaaaaatattaggacggctagtacaaatctaaactgagtaaagtctacaacgaacttaaaaacttacaagtacactgtgactcatggcacaaaatttttaatttcatctatacaaattatgaatgtttttgacgaacatttacaatattgacagcattaatatattgatttccattgaaaacaaggataagtggcagtagtagtttattttttataaaagaaattgggataaatcttaattccagtcaatgatagtaaacagaagaaatttgtaatctgtttactggcggtttgaaatgatgagccgagttttgtgggcgcataataaatcccaatgctgtacctttctgagcggccagttgtagcttctgtacgtcatactcagatagctctggtagccaacccagtactacactgtagttgccacttgctagagccttttccatggcatcaattgatgcaacaggacggatttgatttaactgaacaaccttatccaaaggtaaaccagaactcatcagccactgacgactcaatcttttattgggtgtaacccagagtaaccagcgattttcatgcccggattgacggagtaaaggaagcagaaggtgattgatagctggctggtgctcacagtagatcagttcactgaccattccttttaccatttgtgaatcatattgggatgattcgacaaaagatagccgactggccgttgtgatacttgctgttttgtctattttgagaaccggacagctgtctgttttttgttcttcttccgttccgttagctgccgttttcttctcaataagatatccccaagatgatcggatgcccataatgttcctcgcccataatgaactgtatatttatacagtatatcgttacttgcttaaaagcaagcctattttttttcaaagcgcttcgcaaaaatttacataaaaccgtttttttctgacttaacgattggcagttggaaacagattgcgtatggttttaattacttgttcttgttatctatattgctaataaaaacatgagaaaaatattagttaggatataattcatggagtgataaaaatgtttttatctggggcgcgttttgctcaattgaaacacggcgtatcttcattgggaaaacttaagaaaaaatctcaatttggtgggtttgggttgttacttgacggggtcttgtttgccattagctcagatggcgaactgtatttacgaggaaatagtcatgctgaggtattatttaaagccagaggcatggagaaatttattttttcaaaaaggggcattcccgtgactttacggtactaccgggttaatgagtcactttggcaggatcaaaagcagttgtttgaatatgtcagcttagcttatcaatatacaatggcagaaattatcgataagcaaaaaatgccccttaggctaaaagatctccctaacttgggaatgactttagaacgtcaactatggaaagtcggcatatctaaagtagaagagttgcacgtgctgggagcaaaagcgacttaccttaagttacagcaacacagaaaacagacgaatgtcagcatattgcttgcgttggctggtgcgatagaaggttgccatgttgccgtattaccagagaaaatccgtgatgatttacttctctggcacaaggaattggatcactgtagtttgggttatcattcttaatgaaatttaatcaataggggcatggcccctattcagattggcgcttttctctgcctgtagagccattacggctgtagtactaagttataaaggtgttttttaatgaaataaatttttattattgtgaattgggacgctaccgcattctcgattaagaataataacaaaaaaaagatattatatatttttataaattcttattcattctgaataagtaatattctattttatttaatattagatttgtaatgataattattaatttattgaatttaaataatatattgatatgtaatgtggttttaagttaaaaacaaatcagatctaaaaatatatatttcattttttctgggtgtttaatttattaatcttcatgtggagaaaatattttttataaggttttaataaataaaaaactatataaatgataactatcattttccggataatgatataggccatcttcgttattttttgttattctttgttgtgtttctttatgtcagagttcggcttcagagtcatcatttttgctcaggagaataggaaaactggagaagaacgttgtgcaggtatgtctggctacataatcagcaactgactcagttcgcattgagagttaaaactcctttttagatgataaaggagtgctagaagctaaatacagagttattcaaaaatccatacatctttacgggatgtacctataatttacttaggaagagaaattgaaaaatatatctgttagcacaaacggttcaatcattgaaaattcactcatgttcggtcaatttggctggccagaatatgaacctaatatgacatctaatggccatttaatttcatccgatttacgaaaaatattacttgagcagtgttctatttctaaaaaattgccatctgaacagtggtggaaagagaaacgaaaaaaagatttgcctttgcacttcctggttcgggattatctcaatcatccagccatccagtttaattcccgaactcttttttcatcctgcgtagagacgttagaaaatatcaaattcagtataaatgaaagaagagaaatcgatattcttctccctgtcttctgcgttattagcaattggcagaaaagacatgatattacctctttaaccatggcagaagaggtgtccttgctacatcttgcgaaaatttcaacctatcttgaggaacatacaggggtcagaatacgtttcaaaattctttcggatgccacattctatgccgggatttttggtgatcctatggctgcggcagaacaatatataaaggatctggaagagttcactcaagtaagtaaaatcaatgaaatagttaatattctcgatatatctaagatagtttcattacttcaggataattatgaccgtgcctttccagagcatctgagaaccttcacattgaatccatctttgggaattagtcatgaggaagccattcgtttcaatgcaagcgtcgggagcacggtcaatatatcagatctatctctgacatataatcaaagaaaggctatattttgtgattctatcttccctgattcggagataaagcatgagatcatgaatagagttcacactgccttcgttcattatagagctatgaaggaaacaatggctagtatccgatgggaaaatacgctatttcctaatgcaatccgagccactatccaccataagacaataccattaatgggcgtcaggatatatcctggttacaagagccattcacccaatcttccctatcatggtattgcagttattgaaaatcggaagaatgtctggcaaatgagtattgaacaagaaattcaccaacatggcaaacgactaaggattattaataatcggggagtgagtgacttttatgtagatgccgatattttggagaatatggcggttttgttgcataaattgaactcttagcagaaatcagtataagacgttaccctatgatctaacatatcaacattgaagaacaccccttaatatgggagtaacaacttaacaatgtggaatatgtgctcatatcgcttatcagagggccatccatgcgtaaccttatcttcattattttggggaatatcacattagaaagtgcggtaccgctactttttactgttgggggactggctggcctgcatcttgctccattggcctggcttgcgacattgcctattgcgatacaaatggctgctggaagtgtctgtgcaatccctttttcgaacttgatggcacgttacagccgcagaaccggatttattctggctagtatggcaatgatattcggtggacttgcttcagcgacggctatttattcaggcagtttcgggcttctgctcggtgggcatttcctgattggcatctcgatgattggtattaattttctacggtttgccgctgctgaaagcgttccaaaaaaccgggctgcaacagcaacctctttactgctagcttctggaataattggtgtcattattggaagcgagctctatgggagaggagatagcttgggcttcgaacttccattcatcgggatatacatgatcgtgtccgttatcggaggatgtgcagttcttgctttcgctgcacttgatggtggtcttagatgttcaattaatcgacaaacagaagctgacattagtaaggcatcaggattttcacttattgccacaaatcgccgtttgttttttggaattgtgacaatggtgttaggtcatgcaatcatgctgatagtcatgtcgactgcctcgattgcctctatagattatggtattggaaattcagaaacgggcatattaattggtgttcatcttgtagctatgttcgctcccggtgttatcaccggtatgcttatatcaagaatgggggcgaatcgtattattctcttgggggctatcttgtatcttgtcggtttcctgatagggcttataaatgaagcagtaatggttattatagcagcgccgctgatttttgctggattagggtggaactttatgttcttagggggaactcatattatcaacagtatgcctgatggtatcaataaagtccgtgtccaaggggcgagtgagacgcttctggcctcggtatcgactgtatttgcgcttgcctccggagggatttacggggcatttggttggaaaggactgatttttgttgtcacaacgatgacattgctgactatatcattactttgcattcgtgcacttttgatatcgaatgttgttgatcaatcggactgacttttctccggtaattcattcaatacgaaatagtttttcttatcaccactccatttttgcgttagcacacttatttcagtgatccttcccccatcactgttcttctgccgaggaagtaaaattactcagggtaaattaattaaaatactttttatatataaaataagaaattaaatagattatgaattatatagaaatgaaattatttgcaatgtcattatgaataatgatggtaattattatttattgtgttaacaaaatgccataatagtgattaaaattataaggtgttacttttaaataatagtaactattctgtttggtattctaaagtaattaaaaacgcacctatattaaataaaaaataatatagacttcaatcaaaataacaatcaatattacagttaaaagaaattgtagttatcgtgaactatattaataaataaagggtaataaataataattggggttaaaatggtgagtgaattgaatataataacttaggtagtaagagtacatgactaaatatatgaaggaagtcacatcagtaatgggtgtttttaaccactaaggctgatggatattaactatttttgtataaaggagaatgctgaaagattgcgagaatcgctatagtgatacaacgatagataatgccgaaacccattaaattcacatgacagcgtgggctaaaaacaggtaaaagagttagatgtgggacagtggattacattaatacccaaaaattaattgctgaaggtgaagtgtagagctgaaatctactcgtttgtgtcacagagtacaagtaacttgcgaacggaatgcattcgtataatttattatgagaacatctgaaagctcgttgaactcgaatttatataaccttcatcccgctcaagaggatgtgttttacgagcaggcactctatgaaaacaatccactacacaacctcggttggtatacgttgatagaagaagatgttgatatagtaacttttcagcaagtgtggaatttactacatcaacatattgatatgttacggttacgcatatcggttaatgcggataatgaagctatacaatatatccaagatcaaggtgtacctgaatcaattatatttcatgatgttacaatgcagcctgaacctgaaaaaaaagcacagctttggatgcagcagcaaatagataatcctataaattttttaaaggaaactccatatcaaatttcattgattcgtatgacagatgaaaaatattattttttcactatattccatcatattatgattgatggtgtaggattatttcgactccatgaatatgttaataaattgtacgaatgtattaaaaatggaacatcaatagcttggttatcagaaattccgcaatatttagatacaataattaaagcaagggaatatctaaattcttctcattacgaaacggataaaaactactggtgtgattttttaaaagaaaatgaaatataccctttaactccttgctatcaaaatacgggtagtggtgttggttcgctaacattaccttctgcgatgacatcagatttacgtattttttgtagagaaaataatactaatttgcttgctgtcttttcgagtctagtcatcatcatgatggcagaacttacggggcaaaaagaattaacatttagtactattacacacggaagaaaaagaaagttagacaagcatgtcgttggaatgcatgcaaatatttatccagtacattgtcaggtttcacactcgctaagtgtgattgaacagattaaattcatggaattatcgcaaaaaaatagttatcgctattgtaaatttccccactctcaccttattcgaatcgctaataattttggaatccctttacctaatttatttattttctacgaacgattttcagagtcagcatctgaagtaactcaaaataaacataatcatatagaaggaacttctaatatttatcctatcgtttttcgattcaaggactatagcggcactgatcaggaactaaaaataaatataaattatttgcaggcgtattttagtgatcaagatgtagggaaaatacttgaacgtctgaaaaacttatttgctgcgttgattaaaaaaccttctttattagtcagtgaattgcctattttattagaacaggaacgtcacactctactgtacacttggaaccagcccgatgcgctgtatccacaaaatcaaaccctgcaacagcagttcgaagcccgtgcagcagccatgccggataacgtggcgctggtatttgagggagcaacgctgacttaccgccagttgaatgagcgggcgaaccaactggcctttgtgatccgcgagcactatcagcaacgacacaatcaagcgatgccggcagatacgctggtggcactgtacttggatcgcggtctggagatggtcatcagtattctggcggtgctgaaagccgggggagcttatgtgccgatgtccccggaacatccgccggagcggattcagtttattttggaagacacccaatctccgtgcgtggtgactcagcagcggcacctgacgacactgagtgaatgcacacaagttctgattgaccagccggcactgatagcggcagatgaccaggtggtgacggccggctggccagtggacaatccggtaccggtgaacggagccgctgatctggcatatgtcatttacacctcaggaacgactgggcagccaaaaggcgtattacagactcatcataatgctatgcgtttatttgctaccacccaaggggattatcaatttgatcaaaatgatacttgggttctttatcatgcctatacctttgatttcagtgtctgggaattatggggagcattaatatatggtgggcgtttaattattccaacagtcgattgcacgaaggattttgtcagctttacccgcttgtgttcacaccaaaaagttactgttctgaatcaaactccaggcgcattttatgcttttattgatgcctcgttgagtattggcgctaaatttccctgtcttcgatatgtgatctttggaggagataaacttaatcctgttcagttgaagccctggtgggacagttatggagatcaatcaccaacccttgtcaatatgtatgggataacagaaacaacggtacatgttacctatcagaaattaataaaagacgacgctataacggcatcctgcattggacgaccgttaaatgacatgcatgcctatgttttgaatgactcaggtcatctcgtacctattggtgccccaggggaactgtacatcgggggcgctggactggcccgtggatatttgaaccggccggtgttgaccgccgagcgttttgtggtgaacccgtttgccacggcggaagatcaggcgcacggctacacccgcctgtataaaaccggtgatctggtgcgctggcagccggacggtaatctggaatatctggggcgcaatgattttcaggtcaagatccgcggctaccgcattgagctgggggaaattgaaagcgcgctggcctcgcacccgcaggtgaaacaggcggtggtgattgaccacgagcatgaaggccataaagcgctggcggcgtatctggtcacggacggggagctgccggatgacaccttgatgacgtacctgtccgcccgcctgccggactacatggtgccagccagcttgacccggattgagacggtgcccctgaccctgaacggcaagctggatcgccgggcgttgcctgcaccggtgtggggaaaccgggatggttatgtggcgccgcgtaatgcgctggaaacccagctgtgtgctgtctggcaggacgtattggggctggaacgggtcggcattgaggataatttcttccggatcgggggagactcacttatcgcgattaagctgacggcagccattcgccgtgttttggccgtggatgtttctttggcacaggtgtttagcttgaaaaccgttgccgggatggctgcacagatgggacagcaggcctgcacggtgatcccccacgtcgagttggcgcgttaccccctgtcatttgcccaggagcggatgcggtttatcgaacagtttgagcagggaacccatgcctatcatgttccttatctggtgcaactggatgacggcgcttgtttgtctcagctggaaaccgccattcatcgggtggttgagcgccatccggtgatgaagacggtctaccgcaccgatgaggcggggcaggcctaccagcaggtactggaaggtaatttggttctccggtcacagtcttgtgaggcgtttgacgcactcctgcaaaccgtgcgtgcggaactggccactccgttcgatctgacggcagagccggggctgcgcctgtgtcactaccgggtggccgaacatcattatttattgatgatgtggcaccatattgccattgatggctggtccatcgatatttttatggatgaactggcggaaatttattctgccctacgggaaggtcgtgacagccagctgtcgccactggaaatcacctatggggactatgccagatggcaacgtgactatttgcagggtgaggtgcgtgaacgccagctggcctactggcagcaggcgctggccggttatgaaccgctgtctttgccgacggaccggagccggccgacacaggtggattatcagggccgggatttcaattttgcgctggggagtgaactttcgcatcagttaagggcgctggcgaaaacgcaggaaaccaccctgtataccgttctgctcagtgcgttttatgtcacgctggcgaaactgtccggccagaacgacatcgtgctgggcaccccgaccgacaaccgacatcatgcgcaaacccagccgctgattgggatgtttgttaactcactggtcttgagggcgcagcttgagccggccggcagcgtggaaacgctgattaaacagacccacgcagtgattgcccaggctaaggcgaatcaggacatgccgtttgagcaattggttgatgcgctggagattgagcgcgacaccgcccgccaccctattttccaggttatgtttggggtacagaatttgggtgagggcgggcaaagcagggcaaacctgccgtttagcccggtgaaactggccggggttctatacagccccgccaagtttgacctgagcctgtttatggccgaggagcaggccaatattgccggtggcataaattacgcggtaagcctgtttgacgagtcctcaatagcgcggatggcggatagctatcagcgggtattgacggcgtttgtcgccgatcagaagcaatctctggccgggcttgacgtgttgtccgcgcaggagcgtcataccctgctgcatcgctggaaccagactgacgtgccgtatccgcagagccggacgttgcaacagcagtttgaggctcaggtggtcgccacaccggataatgtggcactggtgtttgccggggaaacgctgacttatcggcaggtcaatgagcgggcaaaccagctggcggttgtgatccgcgaacgctatcagcagcagcgccatgcgccgatgccggcagacacgccggtggccctgtatctggatcgcagcctggagatgatcatcagtattctggcggtactgaaagccgggggggcctatgtgccgatgtccccggaatatccgccggagcgggtccggtttattctggccgacaccgggtcttcgtgtgtggtgacccagcagcgtcacttgacggcgctgggggaatacacgcacaggctgtcactgatcgcggcggatgatccgtcggtgaccgcaggacggccagtggacaatccggtgccggtgaacggggctacggatctggcgtacatcatctacacttcaggaacgaccggtcagcccaaaggggtcatgctgacgcaccaaagcgtgatgaaccgcctgtgctggatgcaatcccgatatgccttaaatgcggcggataacgtgctgcaaaaaaccccttatacctttgacgtctcggtgtgggaactgctggcggctaactgggttggcgcccgtattgtgattgccccgcctgatagccatagacagccggaaaccctgcataaactgatgcaggaaaccggggtaacggtggttcactttatcccgcccatgctcagtgccttctgccagtcgctacaggccttaaggcagcggttggcggaaactgtccgttatgttttctgtagcggggaggccctgactggatcacaggtcaacgcgtttaaaaccattaatccgggcgccagtgccttaattaacctttacgggccaacggaagcggcgattgaagtcacctattttgataccgccgacgaatttaatggcaatgtgcccatcggccgggcgattgataacacccgcctgtatgtgtgtgaaggtgggggtaacctgtcccccctcggtgcgcccggtgagctttacatcgggggcgctggtgtggcccgcgggtattggaaccggccggatctgaccgcggagtattttgtggtgaatccgtttgccacggcagaagatcagacgcggggctacacccgcctgtataaaaccggcgatttggtgcgctggcggccggacggcaatctggaatacctggggcgcaatgattttcaggtcaagatccgcggctaccgcattgagctgggagaagtcgaaagcgcgctggcctcacacccgcaggtgaaacaggcggtggtgattgatcgcgagcatgagggtcataaagcgctggcggcgtacctgatcacggaggggatgctgtcggatgagaccctgatagggcatgtgtccgcccgcctgccggactacatggtgccttcaagctttacccggattgagtcggtgcccctgaccctgaatggcaaactggatcgccgggcgttaccggcgccggtgtgggtgaaccgggacgattatgtggcgccgcgtaatgcgctggaaacccagctgtgtgcggtctggcaggatgtcctggggctggagcgggtcggcattgaggataacttcttccggatcggcggcaactccctgatggctattaagctgacggcggccattcgctatgccctggtagtagaagtcccactggtacaggtatttgaactgaaaaccgttgccggtctggccgcccagatggggcagcaggcctgtacggtgatcccccaccttgaactggtgcgctaccccctgtcgtctgtgcaggaacggatactgtttatcgaacagtttgagcaggggagcagtgtctatcatgtcccctatctggtgcagctggatgatggagactgtttacccctgctggaaacggccattaatcgggtagttgagcgccatccggtgatgaaggcggtgtaccgcactgacgatgcggggcaggcctaccagcaggtgcttgagggcagcctggttctccggtcacagtcttgtgaggatattaacgcgcttttgcaaacggtgaacacggagctggccactcccttcgatctgacgtcagagccgagcctgcgcctgtgtcactatcgggtggccgagcatcattacttattgatgatgtggcaccatattgccattgatggctggtccattgatatttttatggatgagctggcggagatttaccgtgctctgctggcatcccgcgacagccagctgccgccactggatatcacctatggggactatgcaaaatggcagcgtgactatttgcagggtgaggtgcgtgaacgccagctggcttactggcagcagactctggccggttatgagccgctgtctttgccgacggacagaagccggccggcacaggtagattatcagggacggaatttcaattttgcgctggggaatacgctttcgcatcagttaagggcgctggcaaaaacgcaggaaaccaccctgtatgccgttctgctcagtgcgttttatgtcacgctggccaaactgaccggacaggatgacatcgtgctgggaacgccgaccgacagccggcatcatgcgcaaacccagccgttgattgggatgtttgtcaactcactggtcttgagggcgcagcttgagccaaccgacagcgtggaaatgctgattaaacagacccacgcggtgattgctcaggccaaggcacatcaggacatgccgtttgagcagttggttgatgcgctggagattgagcgcgacaccgcccgtcatcctattttccagatcatgtttgggttgcagaatctgggtgagagtctgccagacagggcaggtttgccgtttaatccggtgaaactggacagggttctacacagccctgctaagtttgatctgagtctgtttatgtcggaagagcagtccagtattgccggcggcataaattacgcggtgagtctgtttgacgagtccacgatagcgcggatggctgatctttatcagcgggtgttagcggcgtttgtggcggatcagaagcaatctctggccgggattgacgtgttgtccgcacaggaacgccataccctgctgcaccgctggaaccagaccgacgtaccgtacccgcaggacaaaaccctgcaacagcagttcgaggcgcgtgcggcagccacaccggataacgtggcgctggtatttgcgggggcaacgctgacctaccggcagttaaatgaacgggcgaaccaactggcggttgtgatccgtgaacgttatcagcagcagtgccatgcgttgatgccggcagacacgccggtagcgctgtatctggatcgcagtctggaaatggtcatcagcatactggcggtgttgaaggccggcggcgcctacgtgccggtctcgccggcttacccgcctgagcgtatccggtttattctggcagacaccgcagccctgtgcgtggtgacccagcagcggtatctgacggatttgggggaatacagccacgcgttgtcactgatcgcggcagatgatctgtccgtgaccgcaggccagtcagcagacaatccggcgccggtgaatatgtctacagatctggcgtatatcatctacacctcgggaacgaccggccagccgaagggggtgatggtagaacatgccagtgtcattaatttatcccggtttattgcccgaacacatttactgggggaaacggtaaaggccctgttcttttccaattatgtttttgatgcgtcggtatttgagctattcccggctctgatggccggtgcaacgatttttatcgcaccagaggccgtgacggcggacagtgaccaacttttgtcgtttatcaatacgaacgaaattaccaaggcgtttattcccaccgccttgatgaatcattttgccgacgaactggcacgctcaaccttgcaggttatccataccggtggcgaagcactgaatgcgctgagtctaccgccggacgtcatactgtttaaccagtatggacccaccgaaggcaccgtgtgcgtcactcaaaacttattgcgggacggggatcgggcgattggtaagggaattgataatacccgtctgtatgtccttgatggtgagggcaatttgtcccccatcggtgcgctgggggaactgtacatcgggggcgcggggctggcccgtggatattggaatcggccggcgttaaccgcagagcgttttgtggtgaatccgtttgccacggcggaagatcaggagcagggctacacccgcctgtataaaaccggtgattgggtacgctggcggccggacggcaatctggaatatcgggggcgcaatgattttcaggtcaagatccgtggctaccgcattgagctgggggaaatcgaaagcgcgctggcttcgcacccgcaggtgaaacaggcggtggtgattgaccgcgagcatgaaggccacaaagtactcgcagcgtatctggtcacggacggaacgctgtcggatgaaatcctgatggagcacgtgtctgcccgcttgccggactacatggtgccttcaaactttacccggattgagtcggtgcccctgaccctgaatggcaagctggatcgccgggcgttaccggcgctggtgtgggtgagccgggacggttatgtggcgccgcgcaatgcgctggaaacccaattgtgtgctatctggcaggacgtattggggctggagcgggtcggcattaaggataatttcttccgtattggtggcaactccctgatagctattaagctgacagccgccattcgccgtattttggcggtggagattccattagtacaggtgtttgagttgaagactattgccgggttggccgcacagatggggcagcaggcctgtacggtgatcccccatgtcgagctggcgcgctaccccctgtcgcttgctcaggagcggatgcggtttatcgaacagtttgaacaggggagcagtgtctatcatgtcccttatctggtgcagctggatgatggagactgcttgcccctgctggaaacggccattaatcgcgtagttgagcgccatccggtgatgaagacggtttaccgcaatgacgatgaggggaatacttaccagcaggtgcttgagggcagtctgattttccggtcacagtcttgtgaggagtttgacgcgctcctgcaaacggtacgtgctgaactggccactccgttcgatctgacgacagagccgagcctgcgcctgtgtcactaccgggtggctgaaaatcattacttattgatgatgtggcaccatattgccattgatggctggtccattaatatttttatggatgaactggcggagatttaccctgctctgctggcatcccgcgacagccaactaccggccttggatatcacctatggggactatgccagatggcagcgtgactatttgcagggtgaggtacgtgaacgccagctgtcttattggcagcagactctggccggttatgagccactgtctttgccgacggacagaagccggccggcacaggtggattatcagggacaggatttcaattttgcgctggagagtaaactttcgcatcagttaagggcgctggcaaaaacgcaggaaaccaccctgtataccgttctgctcagtgcgttttatgtcacgctggccaaactgaccggacaggatgacatcgtgctgggaaccccgaccgacaaccggcatcatgcgcaaacccagccattgattgggatgtttgtcaactcactggtcttgagggcgcagcttgagccgaccgacagcgtggaaacactgattaaacagacccacgcggtaattgctcaggctaaggcgcatcaggacatgccgtttgagcagttggttgatgcgctggagattgagcgcgacaccgcccgccaccctattttccagattatgtttgggttgcagagttttggccaagatgagccaaacagggcaggtctgccgtttagtccggtaacactggatggcgctttacacagccccgccaagtttgatctgagcctgtttatggcagaaggcgcgggcagtattgtcggtggcataaattacgcagtgagcctgtttgacgagtccacgatagcgcggatggccgatatctatcagcgggtgctgacagcgtttgtcgccgatcagaagcaacctctggccggatttgacgtattgtccgcgcaggagcgccataccctgctgcaccgctggaaccagaccgacgtgccgtacccgcagagccacaccctgcaacagcagttcgagacgcgtgcggcagccaccccggataacgtggcgctggtatttgcgggggtaacgctgacctaccggcaagttaatgagcgggcgaaccagctggcggttgtgatccgcgaacgctatcagcagcagagccatgcgccggtgccggcagacacgccaatagcgctgtatctggatcgtagcctggaaatggtcatcagcatgctggcggtactaaaagccggcggcgcctacgtgccgatctcgccggcctacccgccggaacgaacccggtttattctggccgacaccgcagccccgtgtgtggtgactcagcagcggcacttaacggcgctgggggaatattcccacgcgctgtcactgatcgcggcggatgatccgtccgtgatcgcaggccagtcagcagacaatccggcgccggtgaatacctctgcggatctggcgtacatcatctacacctcgggaacgaccggccagccgaagggggtgatggttgaacacgccagtgttattaatttatcccagtttattgcccgaacgcatttactgggggaaacggtaaaggcgttattcttttccaattacgtttttgatgcgtccgtatttgagctattcccggccctgatagctggttcgacgatttttatcgcgccggcggccgtgacaagagacagtgaccaattgctgtcgtttatcaatacgcacgaaattaccaaggcgtttattcccaccgccttgatgaatcattttgccaccgaactggcccgctcaaccttgcaggtcatccataccggcggtgaagcgctgaatgcgctgagtttaccgccggatgtcatgctgtttaaccagtacgggccgaccgaaggcaccgtgtgcgccacccaaaactggttgcaggacggggatcgggcgatcggtaagggcattgataatacccgtctgtatgtccttgatggtgagggtaatctgtccccgatcggtgcgccgggggaactgtatatcgggggcgcggggctggctcgcggatattggaaccggccggcgttaaccgccgagcgttttgtggtgaacccgtttgccacggcggaagatcaggcgcgcggctacacccgcctgtataaaaccggtgattgggtacgctggcggccggacggtaatctggaatatcgggggcgcaatgattttcaggtcaagatccgtggctaccgcattgagctgggggaaatcgaaagtgtgctggcctcgcacccgcaggtgaaacaggcggtggtgattgaccgcgaacatgaaggtcacaaagtgctggcggcgtatctggtcacggacggggagctgtcggatgaaatcctgatagggcacgtgtctgcccgcctgccggactacatggtgccggccagcttgacccggattgagacggtgcccctgaccctgaatggcaagctggatcgccaggcactgccggccccggtgtgggtgagccggggcggttatgtggcgccgcgcgatgcgctggaaacccagctgtgtgccgtctggcaggacgtcctggggctggagcaggtcggcattgaggataacttcttccgtatcgggggggattcgattgtcagtatccggctggtgtctaaacttcggcaggcgggtttttcgctacaggtcaaatcgatttttgatgccccgacggtggcgcggttggctaagttgctggcccaggcctccacggcggtcagggtgattgccgagccgggattattaagcggggagtttggcttattgccgatccagcaggccttcttcggccggagcctgccgtgtccgcaccattggaatcaggcatttatgatgcagcttcccggagaaatccggcacgctgatattgagcaggccctgatccggctggccgggcggcacgatatgctgcgtacccgttttgtcagcacggaagacggttaccgtcagtgttatcaggctgagatgccattcgggttgcccgccttacaccgcgctgatgtcagcgtgctggagaaggcggcattacatcaacagctgacgcagtggcagggcgggtttgattatgctgccgggtctttatggcaggctagtcatctgaccgggtacgcggacggcagcgcccggttattcttcgcctttcaccacctgattattgacgcggtgtcctggcgcatcattgcggaagatatgcgtttattactgcaaggcgcaaccctgccaccgaagaccagcagctaccgccagtgggtggccgcggttcatcattatgcggcgcgccatcaacaggaagtgccctactggcagcgggtgatggtcgggaaagagactgaaccggcagccggtgaagccagccagcaccggttggtgctctctgccaaactgaccgataccctgttgcgggaggccaattccggttaccacacggagataaacgacttactcctgagtgcgctcaccctggcgttgtcggccagtttttcacgcccggtgaatcacatcattctggaagggcatggccgggagcccatcgataccacgctggatgtctcagaaaccgtggggtggtttaccacggtgtatccggtgcgcctggaaatgcaggcgggggtgacggaaaccatgatccacaccaaagagatgctcagggcggtgccgaataaagggatagggtacggggccttgcatcaggctggagacttagccggtgagttgccggcgataagtttcaactatctcggccagctggggggagacgccggacagggccgtcatcaagactggtcactgactgacgacgattgtggggccatgatagctagcgataaccccaatcctttgctgctggatatcaatggggcggttcaggcaggcagcctgcaattcagtgtgaactcccgtttgtcaccggcccagactcaggtatttatcacggcacttgagcaggcactcaccaccgttatcacggccggccaaaaacaggcccggttgggcggagtaaaaacccccagtgattatggcattaaaggcgtttcaatcgagcagttaaatcaactgactcatcgtcttgatcatgtgaataacgaaaattcgtctctccatgtagaaaagaaaacaattttggatgtgtaacaatatgttgatattactgaaagaactaattaaaaatcgggtgtcagtatgggtctgtgaaaataagttaaaactggcgtttgcaggagaaacgccccctgttcaattaattgataaagtaaaagagaaaaggcaaagcgtaatagatttcctaaatgaaaaatgtattttctctgaagaggattttcaaagttttatctttaataaaaatcagtctaatttcgatataacttttgctgatcccagccaatattctggaaataaaattgaagcgatatttcccgccaccagtttgcagcagggctttgtttatcattatctggcgcaaccgcaggatgacgcctaccgagtgcagttgctgttggattatcacgacaggctggattttgcggcttatcagcaggcctggacactggcttcactgcgcttccctgccctcaggacggcctttgactgggaaggggaagtgttgcagattgtgacggagggcgccagtatcgggccggccaatttcacgatcaaagatatcagttcattacccgcagaagagtgggatcgggcgattgaagaactccagcgaaatgaccgggcccagccttttgatttaagccagccggggttaatccgcttcaccttaatcaggcagcaggcacagcaggtgacggcactgatcactcagcatcactgtattgccgatggctggagtaccccgattttattgcagaccgtgcatgagtattacaatgcgctggtgcagggacgtgtcctcccgaaaggggtggacacggcctacctggcgactcagcagtatcatcttgatcacaaagatgcctccgatgcgtattgggctgaacgcaaaacccagtttcagggggcgaatgatctttctgcgttgttaagtcacgggattgacctggcgcagataaaaacggttgaaaaaccggccgagcaggtgctgacggtagagggaaacgcctatgggcagctcaagacgatgtgcagggagcagggggtcacgctgaatgtggtgctgcaatttgcctggcataaattactgcacagttactgcggggatgagcagacccttgtcggcaccgtggtgtccggacgagatgtgccggtagacgggattgagtccagtgtcgggctgtatatcaataccctgccgttgaccgtgcagtgggagcctgccggcagtgtactggccgttttacacgcaatccagaacgatattgcggcactcaacagccacagcgcggtgtcactggccagtttgcagcccgacggggcgcgtttattccacagcctgctggtctttgaaaactacccggcaccggtgataagcgagcacggggcagggattgaaaacaaactggcattccgtcaggccatcgaaaaagtggattatccggtgttactgatggcctatgaacagggtgacagcctgaccgtgaaattgagttatggcgaagactggctggcgggtgaacaggcgcggcgtttactgcaccagcttgagggcatcctgcataccgtcgcccgcgatccacaccagccgcacccgtcggtggaatttctcagtgacgacgagcgccacaccctgctgtaccgctggaaccagaccgacgtgccgtacccgcagagccacaccctgcaacagcagttcgaggcgcgtgcggcagctatcccagataacgtggcgctggtgtttgcgggagcaacgctgacctaccgacaggtcaatgaacgggcgaaccagctggcggttgtgatccgcgaacgctatcagcagcggtgctatgcgccgatgccggcagacacgccgatagcgctgtatctggatcgtagcctggaaatggtcatcagcatgctggcggtactaaaagccggcggcgcctatgtgccagtctcgccggcctacccgccggagcgaacccggtttattctgaccgacactgcagccccgtgtgtggtgacccaacagcggcacttaacggcgctgggggaatattcccacgcgctatcactgatcgcggcggatgatccgtccgtgaccgcaggccagtcagcagacaatccggcgccggtgaatacctctgcggatctggcgtacatcatctacacctcgggaacgaccggccagccgaagggagtgatggtagaacacgccagcgttattaatttatcccagtttattgcccgaacgcatttactgggggaaacggtaaaggccctgttcttttccaattacgtttttgatgcatcggtatttgagctattcccggccctgatggccggcgcggcgatttttatcgcgccggcggccgtgacaggagacagtgaccaattgctgtcgtttatcaatacgcacgaaattaccaaggcgtttattcccaccgccttgatgaatcattttgccaccgaactggcccgctcaaccttgcaggtcatccataccggcggcgaagcgctgaatgcgctgaatctaccgccggacgtcacgctgtttaaccagtacgggccgaccgaaggcacggtgtgtgccacccagaactggttgcaggacggggaccgggcgatcggtaagggcattgataatacccgtctgtatgtccttgatggtgagggtaatctgtccccgatcggtgcgccgggggaactgtatatcgggggcgcggggctggctcgcggatattggaaccagccggcgttaaccgccgagcgttttgtggcgaacccgtttgccacggcggaagatcaggcgcggggctacacccgcctgtataaaaccggtgattgggtacgctggcggccggacggcaatctggaatatcgggggcgcaatgattttcaggtcaagatccgtggctaccgcattgagctgggagaaatcgaaagcgcgctggcctcgcacccgcaggtgaaacaggcggtggtgattgaccgcgagcatgaaggccacaaagtgctggcggcgtatctggtcacggacggggagctgtcggatgaaatcctgatagggcacgtgtctgcccgcctgccggactacatggtgccggccagcttgacccggattgagacggtgcccctgaccctgaatggcaagctggatcgccaggcactgccggccccggtgtgggtgagccggggcggttatgtggcgccgcgcgatgcgctggaaacccagctgtgtgccgtctggcaggacgtcctggggctggagcaggtcggcattgaggataacttcttccgtatcgggggggattcgattgtcagtatccggctggtgtctaaacttcggcaggcgggtttttcgctacaggtcaaatcgatttttgatgccccgacggtggcgcggttggctaagttgctggcccaggcctccacggcggtcagggtgattgccgagccgggattattaagcggggagtttggcttattgccgatccagcaggccttcttcggccggaacctgccgtgtccgcaccattggaatcaggcatttatgatgcagcttcccggagaaatccggcacgctgatattgagcaggccctgatccggctggccgggcggcacgatatgctgcgtacccactttgtcagcacggaagacggttaccgtcagtgttatcaggctgagatgccattcgggttgcccgtattacaccgcgctgatgtcagcgtgctggagaaggcggcattacatcaacagctgacgcagtggcaaagcaggtttgattatgctgccgggtctttatggcaggccggtcatctgaccgggtacgcggacggcagcgcccggttattcttcgcttttcaccacctgattattgacgcggtgtcctggcgcatcattgcggaagatatgcgtttattactgcaaggcgcaaccctgccaccgaagaccagcagctaccgccagtgggtggccgcggttcatcattatgcggcgcgccatcaacaggaagtgccctactggcagcgggtgatggccgggaaagagactgaaccggcagccggtgaagccagccagcaccggttggtgctctctgccaaactgaccgataccctgttgcgggaggccaattccggttaccacacggagataaacgacttactcctgagtgcgctcaccctggcattgtcggccagtttttcacgcccgatgaatcacatcattctggaggggcatggccgggagcccatcgataacacgctggatgtttcagaaaccgtggggtggtttaccacggtgtaccccgtgcgcctggaaatgaaggcgggggtgacggaaaccataatccacaccaaagagatgctcagggcggtgccgaataaagggatagggtacggggccttgcatcaggtcgggaatttagccggtgagttgccggcgataagtttcaactatctcggccagctggggggagacgccggacagggccgccatcaagactggtcactgaccgacgacgattgtggggccgtggtggccagcgataaccccagccctttgctgctggatatcaatggggcggttcaggcgggaagcctgcaattcagtgtgagatcccgtttgtcaccggccctgactcaggtatttatcacggcatttgagcaggcacttaccaccgtcatcacggccggccaaaaacaggcccggttgggcggagtaaaaacccccagtgattatggcattgaaggcgtttcaatcgagcggttaagtcgttttcagcagaggtatcagattgaagcgctgtatcccgccaccagtttgcagcagggtttcgtttatcattatctggctcacccgcaggatgatgcttatcgagtgcagttactgttggattatcacgacaggttggattttgcggcttaccagcaggcctgggcactggcttcactgcgcttccctgccctcaggacggcctttgactgggaaggggaggtgttgcagattgtgacggagggcaccagtatcgggccggccaatttcacgatcgaagatatcagttcattaccgccagaagagtgggatcgggcgattgaagaacttcagcaaaatgaccgggcccagccttttgatttaagccagcccgggttaatccgcttcaccttaatcaggcagcagacacagcgggcgacggtactgatcactcagcatcactgtattgctgacggctggagtaccccgattttattgcagaccgtgcatgagtattacaatacgctggtgcagggactgcgacccccgaaaggggtggacacggcctacctggcgactcagcagtatcatcttgatcacaaggaggcctccgaggcgtattgggctgaacgcaaaacccagtttcagggggcgaatgatctttctgcgttgttaagtcacgggattgacctggcgccgataaaaacggttgaaaacccggccgtgcaggggctgacggtagagggaaacgcctatgggcagctcaagacgatgtgcagggagcacggaataacgctgaatgtggtgctgcaatttgcctggcataaattactgcacagttactgcggggatgagcagacccttgtcggcaccgtggtgtccggacgagatgtgccggtagacgggattgagtccagtgtcgggctgtatatcaataccttgccgttgaccgtgcagtggaagcctgccgacagtgtactggctgttttacacgcaatccagaacgatattgcggcactcaacagccacagcgcggtgtcacttgccagtttgcagcctgacggggcgcgtttattccacagcctgctggtttttgaaaattacccggcaccggtgatgagcgagcacggggcaggcattgaaaacaagctggcattccgtcaggccatcgaaaaagtggattatccggtattactgatagcctatgaacagggtgacagcctgaccgtgaaattgagttatggcgaagactggctggcgggtgaacaggcgcggcgcttactgcaccagcttgagtacatcctgcataccgtcgcccgcgatccgcaccagccgcacccgtcggtgagattcctcagtgacgacgagctccataccctgctgtaccgctggaatgagaccgacatgccatacccgcaggacaaaaccctgcaacagcagttcgaggcgcgtgcggcagctaccccggataacgtggcgctggtatttgagggagcaacgctgacctaccggcaggttaatgaacgggcgaaccagctggcggttgtgatccgcgaacgctatcagcagcagcgccatgcgccgatgccggcagacacgccgatagcgctgtatctggatcgcagtctggacatggtcatcagcatgctggcggtactaaaagccggcggcgcctacgtgccagtctcgccggcctatccgccggagcgtatccggtttattctgaccgacaccgcagccccgtgtgtggttactcagcagcggcacttaacggcgctgggggaatattcccacgcgctgtcactgatcgcggcggatgatccgtctgtgaccgcaggccagtcagtggataatccggtgccggtgaatacctctacggatctggcgtacatcatctacacctcgggaacgaccggccagccgaagggagtgatggttgagcatacaggtgtggtgaatctgtcccagtttattgcccgaacgcatttactgggagaaacggtaaaggcgttattcttttccaattacgtttttgatgcgtccgtatttgagctattcccggccctgatagccggttcgacgatttttatcgcaccggcggccgtgacaggagacagtgaccaattgctgtcgtttatcaatacgcacgaaattaccaaggcgtttattcccaccgccttgatgaaccattttgccgccgaactggctcactcaaccttgcaggtcatccatactggcggcgaagcgctgaatgcgctgaatttaccgccggacgtcatgctgtttaaccagtatggccccaccgaaggcaccgtgtgcgccacccaaaacttattgcaggacggggatcgggcgatcggtaagggaattgataacgtccgtctgtatgtccttgatggtgagggcaacttgtctccgatgggggcaacgggggaactgtatatcgggggcgccgggctggcccgtgggtattggaatcggccggaactgaccgcggagcgttttgtggcgaacccgtttgccacggtggaagatcaggcgcggggctacacccgcctgtataaaaccggcgattgggtacgctggcggccggacggcaatttggaatatcgggggcgcaatgattttcaggtcaagatccgtggctaccgcattgagctgggggaaatcgaaagcgcgctggcctcgcacccacaggtgaaacaggcggtggtgattgaccgcgagcatgaaggccacaaagccctagcggcgtatctggtcacggacggggggctgtcggatgaaaccctgatggcgtacctgtctgcccgcctgccggactacatggtgccatccagctttacccggattgagacggtgcccctgaccctgaatggcaagctggattgccgggcgttaccggcgccggtgtgggtgaaccgggacgattatgtggtgccgcgtaatgcgctggaaacccagctgtgtgccgtctggcaggacgtattggggctggagcgggtcggcattgaggataacttcttccggatcgggggcaactccctgatagccattaagctgacagccgccattcgccgtgttctggccgtggaggttccactggcacaagtgtttgagttgaaaactattgccgggctggccgcacagatgggacagcaggcctgcacggtgatcccccacgtcgagttggcacgctacccgctgtcatttgcccaggagcggatgcggtttattgaacagtttgagcagggaacccatgcctatcatatcccttatctggtacagctcaatgatggggcctgcttatcccttctggaaacggccattcatcgggtggttgagcgccatccggtgatgaagacggtctaccgtaatgacgacgaggggcaggcctaccagcaggtactggaaggtaatctggttctccggtcacagtcttgtgaggcatttgactcactcctgcaagcggtacgtgcggaactggccactccgttcaatctgacggcagagccggggctgcgcctgtgtcactaccgggtggccgaacatcattatttattgatgatgtggcaccatattgctattgatggctggtccgtcgatatttttatggatgaactggcggaaatttactctgccctgcgggaaggtcgtgacagcctgctgccgccactggaaatcacctacggggattatgccagatggcagcgtgactatttacagggggaagtgcgtgaacgccagctggcctactggcagcaggcgctggccggttatgaaccgctgtccctgccaacggaccgaagccggccaactcaggtagattatcagggccgggatttcaattttgtgttggggagcgggctttcagatcaactgagggcgctggcgaaaacgcaggaaaccaccctgtataccgttctgctcagtgcgttttatgtcacgctggcgaaactgtccggccagaacgacatcgtgctgggcaccccgaccgacaaccgacaccatgcgcaaacccagccgctgattgggatgtttgttaactcactggtcttgagggcgcagcttgagccggccggcagcgtggaaacgctgattaaacagacccacgcagtgattgcccaggctaaggcgaatcaggacatgccgtttgagcaattggttgatgcgctggagattgagcgcgacaccgcccgccaccctattttccaggttatgtttggggtacagaatttgggtgagggcgggcaaagcagggcaaacctgccgtttagcccggtgaaactggccggggttctatacagccccgccaagtttgacctgagcctgtttatggccgaggagcaggccaatattgccggtggcataaattacgcggtaagcctgtttgacgagtcctcaatagcgcggatggcggatagctatcagcgggtattgacggcgtttgtcgccgatcagaagcaatctctggccgggcttgacgtgttgtccgcgcaggagcgtcataccctgctgtatcgctggaaccagactgacgtgccgtatccgcagagccggacgttgcagcagcagtttgaggctcaggtggtcgccacaccggataatgtggcactggtgtttgccggggaaacgctgacttatcggcaggtcaatgagcgggcaaaccagctggcggttgtgatccgcgaacgctatcagcagcagcgccatgcgccgatgccggcagacgcgccggtggccctgtacctcgatcgcagcctggagatgatcatcagtattctggcggtactgaaagccgggggggcctatgtgccgatgtccccggaatatccgccggagcggatccggtttattctggctgacaccgggtcttcgtgtgtggtgacccaacagcggcacctgacggcgctgggggaatacacgcacacgctgtcactaattgcggcggatgatccgtcggtgaccgcaggacggccaatggacaacccggtgccggtgaacggggctacggatctggcgtacatcatctacacctcagggacaaccggtcagcccaaaggggttatgctgacgcaccaaagcgtcatgaaccgcctgtgttggatgcaatcccgatatgccttaaatgcggcggataacgtgctgcaaaaaaccccttatacctttgatgtctcggtgtgggaactgttggcggctaactgggtcggcgcccgtattgtgattgccccgcctgatagccataggcagccggaaaccctgcataaactgatgcaggaaaccggggtaacggtggttcactttattccgcccatgctcagtgccttctgccagtcgctacaggccttaaggcagcggttggcggaaactgtccgttatgttttctgtagcggggaggccctgactggatcacaggtcagtgcgtttaagaccattaatccgggcgcgagtgccttaattaacctttacgggccaacggaagcggcgattgaagtcacctattttgataccgccggtgaatttaatggcaatgtgcccatcggccgggcgattgataacacccgcctgtatgtgtgtgaaggtgggggtaacctgtcccccctcggtgcgcccggtgagctttacatcgggggtgctggtgtggcccgcgggtattggaaccggccggagctgaccgcggagtattttgtggtgaacccgtttgccacggcagaagatcaggcgcggggctacacccgcctgtataaaaccggcgatttggtgcgctggtggccggacggcaatctggaatacctggggcgcaatgattttcaggtcaagatccgcggctaccgcattgagctgggagaagtcgaaagcgcgctggcctcgcacccgcaggtgaaacaggcggtggtgattgatcgcgaacatgaggggaataaagcgctggtggcgtatctgattacggagggggtgctgtcggatgaaactctgatagggcatgtgtccgcccgcctgccggactacatggtgccttcaagttttacccggattgagtcggtacccctgaccctgaatggcaaactggatcgccgggcgttaccggcgccggtgtgggtgaaccgggacgattatgtggcgccgcgtaatgcgctggaaacccggctgtgtgcggtctggcaggatgtcctggggctggagcgggtcggcattgaggataacttcttccggatcggcggcaactccctgatggccattaagctgacggtagccattcgccgtgaaatagatattgatattcctttaagcatactgtttagtcacaaatgtatttctttattaacagaatggctggaatccgggtgtttaaaatacaacttacttaatttattaactccagaatcaacagcaacgaataagttatttatgatccatgcggcgggttgcggtagtgaggtatatgatcctttagcaaaagcattgtctgatgtgtataactgtataggtatcgataattataatctctttacggataatcacatagagtcactacagaagatagctcaaatctatttggaattaattttgactgaaacttctattgataaacctattaaaattttaggatggtcattaggaggacaattagctatggagattgcatttcaattagaacagaatggtgcaaaagatattcagctattcttattagatacagtgatcaatactgttcaattaacagaaattaaaaatcaattagatatgtcatatgtacttagtgaggctgcaataaaattgcaggcaatgggagttggggatgcttatataaataaagtgttggatgcaatgccttttgaacataaaatagttaattgtaatttgagtggaaaattaatgcatacaaatattactttatttaaagcaggtcaaatgaactcagattataaaggagatattggattaacggtaaatcagttaatagcaaaaatgccggataataatatttcggcatgggtgacaaatccattagtgattaaattggttaatgatcgttctcacgctgatattcttgaatctatttctattgttagtgcagaaataatcgacaaattatcaattgagggaaatatatcaatataagttaattttattgctatttttgatttagtgggcctgattttaggcccattgattgtatgatcagatatccgactgtgtgagttgttttatcaatgaaacaaattcaggcagaagttcaaccaataaccctatttgttgtaatacaagttgtactttgccgctgctaccagaagataccagattgatgctctcagccagacgctctgaaatgcgttgcaggcgttcatcatcaacccatccttgctgcaatgccgattcaacctgaaaaattgcatcgttcagaatatccagaatgacctgatcattgagccggtcacgatgcgcacccaaagcagaaatgtaacttagcatcgtatggttaagacagagtaggcgaaaggcttcttcctgagaaacacggtaatttttgggctctgatgccatgtttgatattacggatgctaattcagcatcacaattatgggcatcacgacgggcgatccgataattcaggctattattcttgccttggtaatattgcccgacaatagcgtcaagataacggcaattggcgatcattgtccggttaatcactctcggcaactggcggaatttccaatctggccagataaaactgacggccagcaaagcaataccacagcctattaatgtgtctgtaattcttggcaaggcaacttcaaatccttcacccaataaattgaaactcagtaacaccagcagcgtaatgaacagtgttgcatgtgcatattgaatattacggaaggcaaaaaacagcacacctgaaatgataatcagcaccagttgcccttcgatggaaggaacaaaatagaggattggcaagccaatcaagatcccagccagtgtccctgtgacgcgcagtgccagccgacgtcgggtcgcgctgtagttaggctgacagacaaacaggctggtcagtaaaatccaatacccacgttgcagatcaaacaattgaataatggcataaccggtacacagcaaggccgacatgcggatagcgtggcggaaaagagcagactttggcgtcagattactgcttatcctgaaccagacatcacgccagccagttaaggcttcattggataattgagtatcctcttgcttaccactttgagacgcgttttggagaagtggggattgctcagaattcagccctgatagttgagcatcaatcgcccgtaaatttctcagcaaattgtagaacgccataatttgcgtgtcagcgccttgctgatttttcaagcgttcaagagaactttcaagatagttgaacgcattctcaaaacgtgagttatgctgatatggcttacggagaattatcgattgcgagacctgttcgcatgcacgagcctgcatggacagcaatcgctgacaacgaaacaaaatatcgctatgtcgaaaagtctcccgcaatttttgatactgaacatgagacgaactggcacgctcatgaatatcttgggcaacaaaataataatgcagtgtgtgacgcgtgccccgttgcccacgatcgcctttcagacggctcagcaaagaaattttggcttgattgagcgtggtaactaatgcgctgtttgccatggcaacatcaaacattgattgcttatattcttcagcttcggaatcagggtcaaacaggctggttttggcatagagataggcagaaagctgctggtaacaacgtgccaaattttcttgcaagggacgaatagggaacagtaaatgccccgttaacgttagtaagttataccaaattgcacccgtgagtaataataaaggctgctgataccaaagaggaaatatcgacgtaccgagcatggtgtaaatggcaatcagtaaggcaccaaaggcgatggtagcatagcgttgtccaagggcgccgagcagaataaaactacaggtagataccgctagcccaaccatgaaaagccacgggtaaggaaaaagcagtgtgatggacgtagaagcggcaaagaaagaaactagggtaatcacaaggttgcgcaggcggccaactaaacgatcatccagatccgttaatgccgcagcaacaacacctaatgtcagggggatcgttattttaggctcttcccccaataaccaagggacgagggtcgttcctgtcagtgcaataaatatacggatataatagaggacgtgactgttatacagaaaatgacgggagctggataaaaccgttagcacaaaatactcctaacaacatttacgtgatcgagtagttcaacaattttcaggtacggtgccacgataatggaactcaaatcaacgcaaatgggccaacgccttgcccagcatccttataacagggtgcgtttacttaacgctggtattgaagtcagcggtgataagcaccagtaccttattccatttaatcagttaatgagtattcagtgtaagcgagggattatttggggggaactggaatttgagttgtatgaaggaaaagttgttcggctgcatggcacggaatggcagcaaacacagcacttttaccattacttgttgaaagaatggcaacaatggagccttgacatgagtgatgtcagtgctgatgtgctggccgctcaagtcaatgaaatcaataaaatcacacagcaggatcgctggttcaaaactgcggacttgctctcattacagcagcaaattcaggaagcatttcaggccctccctttgccattagcgcgaatcgaacaatttgagaactgtcgtgatgattatcgaatgtgtttggattggctggatgagggggggaaaacgattaaaatccttaaccagcaatgggttgatcgtatattgcagcaatatgcagaatttttccaaactatcgaaactacgccactcaatcgttttcagtgccaggcggtcgttaatggtgaaaaatctatattggttttggcaggagcgggcagcggaaagacctccgttctagttgcgcgtgcagggtggctgttattacgtcaacaagcgcttcctgagcagattttgctgctggcttttggccgccaggccgctgatgaaatgaataaacgtattcagaaacgcttgggaacaaaagagatacaggcaaaaacattccatgctttggcattgcatattattcagcagggtagcaataaagcgcccaagatgagtgaattagagacggatgcacagaagcgtcgtgattttctcatccaggaatggcaaaaacagtgcagtgaaaaaaaagtacaggcaaaaggctggcgcgaatggttgaatcaagagcttgattggcaattgcctgagggggagtattggcatgataaacaactctcgattcgattatctgaccgtttggagcgttggctggagctgatgcgaatgcacggtggcagccagaaagagatgattgaacaggcatctcctgcttatgctgacacattccaaaaacatatacggcttatggctcccttgctgaaggcttggaaattggcattaaaatctgagggtgctgtggacttttccggcttgatccatcaagccgtgaatattctggaaaaagggcgctttatcagcccatggaagcatattttggtggacgaatttcaggatatttcaccattgcgagcaaaattgttggcggtgttacgagtgcaaaataaacaaagccatctatttgccgtgggagatgattggcaggcaatttatcgctttagtggtgcagaattaacgttaacaacggcattctcaacctattttggggaaggtgcggaaagtgcggaatgtaccttggacaccacttatcgtttcaatgatcgcattggtgagattgctaaccgctttatccggcaaaatcccaatcaattgaacaaaccgctcaatagcctgataaaagggaataaaaaatcagtcgtgattttgccgcaggagcagttggaggcactgctgaataaaatgagtggttatgtcacgaagcaggaaacgattctgttgttggggcgttatcaccatctcaaacctgaatttttgaaaaaagcgtctacacgctggccgaatttgaatattgaatttatgacaatccacgcatccaaagggcagcaatcggactatgtcattatcttgggattgcagcagggacaggatggctttccagcgccggcaagggaatccgtgttggaacaggtattattgccgcagcctgaagattttcccgatgcggaagaacgtcggcttttgtatattgcactgacgcgggcgaaaaaacaggtatggttgatgcaggagccgaaaaatccgtcggtattcattcatcaattaacacaattgggcgtgccaacccaacgcaagccatagaatgacagtgggaggcaaaatgagtgatcaatacatagcggacattctgaaaaataccaaggccatagcattagtaggagcgagtgaaaaaactgaccgaccaagctataaggtcatggagtatttgcttaatcagggctaccacgtcattcctgtcagccctagattggcgggaaaaacagtgttaggacagcctgttgttagccaattggcggatattgaacagtcggttgatatggttgacgtgtttcgcaacgccgaggctgcgagtggtatggctgaagaagctgtcgccattggtgcaaaagtattttggctgcaaaaaggggttattaatgaagaagcgaaatcactggcagaaaatgcaggattgaatgttgtgatggatcgttgcccaaaaattgaaattcctcgtttggccatggaaaaatgaataaggcgatggttgtttactactcatcgccttactgggattgtttggataataacaggggcgtttaatttcgtaatcgtggagcctgcaattgactgcgaatggattcagccaactcatctagagaagattgttctggatgatcatctgacgtttcgtaagccaattgagcttctgccagataggtatggactggctgcccatcatcaccttccatcacaacgtgataccacggggctgaacgcaaggtagcattcgatgctatatcattttcctgtggctgttctaaagaatattcagcatcaatatctacaataacacctaaataacctagcagcttatgtcgtacttgctgaccgataccgaatttgctggcgatcatcatatagtcacctccaaagaaaccttgcaaagattcttatataagggcagtaaggtaaatttcaagtgcacactcggtaaacggaattttttgtaatcaaacaagatggcatgtgactgccaccccataatttcaggttagctgttgcatatataaaatacaatactaaaagtaggtttgacgtgccaaagttcgtattatcttgtcaggagggaggacgaaataatggctacaaagggtatgactatttatgtttatgggcgggtacagggagtcggcttccgttatcaaacttattgttgggcaaagaaaaataaactagtgggatatgttcgcaatatggatgatggtagtgtcaaaattgttgcttgtagtagtgatgagcaacttaaaaagttgacacattggctggagcagggagggccaccgggggctaaggttgaacactttaaatctcagctttgtgaagtggaggagatgaccgattttagcatccgccattagcggcggatgataggtcagatacattttaccggttttgggaggcctgcaattttggttgcctgttttgcaggtcctttaggaaacagacgatagagataacggctacttcctttttcctcaccatatttttgtgaaattgctttgactaacatacgaatagcgggagaagtattaaattcttcgtagaattcacgtacaaagcgtatgacttcccaatgctgttcagtcaaggtgatatcttcctgttcggcaagtagtgacgccatatcttcttgccagtcactgctgttttttagataaccttgtgcatcagtttcgatcgcacgatctttaaataccaacataactctttaaccatccaataacgatgggagcaatttagcaaaaatcaccattattcccaagaaagatcgccaaatctgctgaagaaataagccaacgaatagcaatgtgagtaatttagcggcagttgaacagataaatactttacattgagaacagtgatgtttatagtgcacgacatcgcggaggggtggccgagcggctgaaggcagcggtcttgaaaaccgccgatgggaaaccatccgagagttcgaatctctcctcctccgccatctacacttctactagcatctcctaaagtctattttccccagtaaaatcaaagaaaacttcaatatctaactctctcaaggtctagcgtcgtcttcctaaatctatgcaatttgttgtatagttttttgtatagaaattccctctacaattttcctatacaatattggtgatttatgaagctgacagacatggcaatcaagcgtgctaagccaaaagaaaaatcatatacgctggcggacggtaacgggctatctttgttagttgaaactaatggatctaaaggttggcgctatcgttatcagttcacaggtaaaactaaaatgatatcgttaggtatctacccagttgtaactctcactgaggcaagagctaaaagagatgaggctagaaaacaggtagctaacggcatcaatccgagtgaagccagaaaagcggagaaagtcgcatcaattagccagtctgagaatacatttaaaaatatcgctctcgaatggtacgaaggtagaaaagatagatgatctgtcggttatcgtgacgacatgatggacgcattcgaaaaagatgtgtttccttatataggtgatcgcccgattgctgacattaaaccaatggaactactcgaagtgctttctgttatggaaaagcgcggcacaactgagaaattgaagaaagtccgccagcgttgcggtgaagtttggaagtacgccattattacgggcagggcggagtataatccagcaccagatttagctagtgcctttgttcctcataagcgtgaacactacgcacatctttcagtaagcgagttaccagaattcctttcttctatagataaatatatgggaagccagattgttagagtggctttacggattcttatattaaccggattcgaccaggcgagttaagaaaggctgagtggtcagaaattaattttgatactggtatatgggaaattccggccgaaaaaatgaaaatgcgccgccctcatatagtgccattgtctgaacaggttattgagttactgaaacagatacacccaatcagcggtagttatcaatatatttttcttagccgtactgattatagaaagcatatatctgatatggcattaaatacgatgattaggcgtatgggttatagcggtagagccacaggtcacggctttaggcacaccatgagcactatattgcacgaacaaggctataacactgcctagattgaaactcagcttgcccatgttgataagaacagtattcgaggaacttacaaccacgcccaatatctggatggtcgcagggaaatgctgcaatggtatgccgactacatggaaacactcgaacagggcaaaaatgtggtgcatagcaaatttaagaaacgtgcttaactggataaatagacagcgataattgtctttagtagactattgaagacgttaaagaataaagctatgcctaggttgatccccgaaaacccgtacacctctacggattggcatagctcctactgaatgagggcgtgaggtggcgggatggcaagagtaaaacctaaagaaataacttcatggtttgatataagtagatatgagcaattattagatttaacagtgttagaggttattgatgatttgaagaatagagtattttctttatatgattacgaagatgaagatgaagatgaagatgaagacgatgcagatgatggttctccaacacttaatattgatgaaatacgaaagtcaatattaagagggttggagaaagggttagttaattacaacagtttaattatccatgatataatttcggatttacatgatggttctgatgaaaaaaatattccggttataaaagatgaatcctttgataaaagtcaggaatgtgaatttattgtaaatggacaccccataagatgtgttgatttttttaataaagaatatgatgagcattctattgaggggaagtcttgcaatttatttaatattggcgatttagcatcctactatagaggcttattaaggcaaggtgacataatggaggaagttaataaacctgtaaaggtaattggtggtaacatattttcgagtataaacaaagttggttatttaggagatgggtttaatgatgaattggtagttaaatttaacataggagattattctgatgatgaactacttacagaatttaaaggacttttaaaaatatggagacttggaacagaaatagatgaacctaaaaaaacaataatagaattggattgtcttcattgaagaagatattcacttataaagtatttcctttcattgatttaatgctatgggaaaaaataaaccaaaagaaaatcagcaatgaattatatgctagattattatttcctctaagtgaaggaaatataatgggaggggttcaaatcaaagatactgttagaccgttcgttgaaaaaataattttcgatgattttttacgatatttatcgttctatgtaaagaaaaatgaataccttaaagatatgagattttcagatgtcatgaaactcgccgagatttgagaccgatgattttggtagataaatcatttttgtgattatgtctatctaaaacaagataatggaatgacaatacccctgtaatctaacaaagtccgctatggaatattaagggcaagttaacagggggctaaatgtcaacaatcacagcatcgaaagaaaaccttatccgcttacccgaagttcagcgcagaactggctacggtaaagcgtggatctacaaactcattgcagacaataaattcccgaagcaagtcaaaatgggtactcgctcagtcgctttcgttgagtcagaaattgatgactagatatcacagcgtattgctgaatctcgtggcgaggtgatgtaatgaaaagctttatattcctgccaacagtagacaatgtgaataacccgtatagccgaaaacctgctaattaaggaataacatcatggaaaaaattactgccttgattggcaacggtcaaactcaccctaaattcagccagagcgatatttcaattatccgtaaggcggttatttcgggtaactggacggcaattaacaagggcatttgcacactcactgacttgggtttacgccataacggacaggggcttgtttggcttaattctggtgtatcggttcacgatgcagatagtgatatagggctggcaggtaggtcatgctcccaatagttagattattgtagtaaactttccattttttattactggtgagatatggctaaagttgatgtggtttgtcgttattgtcacaaagcagaggaggtcaaagggcatggaaaaggaagcagtgggcacccgcgttatcactgttatgcctgccgtaaaaccttccaactgaattacacctatcaagcctgcaaacccggagtgaaagaacaaatcactgatatggcgataaataacggcgggatcagagacactgcacgtgttttgaacgtcgggatcaataccgtgcttcgcacgttaaaaaacatgaacccagacaagtaacaacacggcctctggcaggaagtgagattcacattatctgcgaaattgatgagcaggggtcatttgtcggcaacaagaagaatcaacgcgggctctggtatgcgtgggaaccaaaccagaagcaaatcaccgcacatgtatttggcgatcgcagtaaaaaaacgctggaaaaactgttggcgcttctggcatcgtttgaaatccagtattattgtactgataattatgctgtttatgattgccttcctgagagaactcacctcagaggaaagaaatttacccaacgcatcgaaagaatgaatctgaccctgcgtactcgaataaaaaggctgaatcggaaaacgatctgctactctaaatcagaaatcctgcatgacaaaatcatcggaacgttcattgagcgtgaatactatcttgcaaggataatctaactattgggagcatgaccggcaggtaaggataaacaatcctttgagtatcattcagaggtgtgcccagttaacgcattgaataatggtagctattatggatttgtccagctaaaggatatcgatagttacgcattgaatatcattacttcaatcagttctgaatataacacacgcaaaaatggtgcctccttagcgacgttcgcgttactgattgaccagaagcaacggaaacaggccgtggataactggattttataccgcaatccaaaccagccagataagtacaccattctcaataagcatcatgaactggcgaagtgctatcaggctaaaggctggatgcgtgagccattggtgtatatcgcacgggtgattagggacaatgcagaatttagccggctaatgaaacgactgggttatatcaaggttagaactaggaaaatcacaggcagccttcaagacttctgggtttatcggcacaaagagaaaagcacctccttgcgcacaaaaaaaaccttaaaaacaataagttaatcccatttgtccagtatgcaaaacgaccagcgagagccttcgatcgcattgctgtagatggtcagtggctctatgtctatgccgatcacattcgttttctgaccaaaaagcgccaccgtgtcgagggtgttcgggttcagggttacacagcgaaaggaatagatctgcgagaggtcatgtgatgggaattattaactatagggatgctgggaggttaaggagtcttactgttgaagtcctcactttgggtgcaacaatagctttgggtcagttccttaacgcattgatatataatcagacggcatatttgcagtctggtcataatatggtcgtatcatttagcgacgcggttaatttgcgatcctcattgagtggagctcaaaaagaaaaggatagcacggcgaatgctaccctttggcgtgactcagatttgagtcatgagttaaatcaatcagttacccgtaatccaaatctggtttacgaagaattacaacagcttaagaggctaccatctttaagagggggagtgaaccaagtaaaggatatttacttggttagttattgctcagataaccatgtgaataatgttcactcagttaaccaagtcaatcttattgccttggatagccattgtacttattgtgcgtttattaaccatcgaacttattgtcggttggttcagccttttggttcaatgcctcgagattgtagttctttgcgaagggtgcgttttatccatgtagcgagggatggatcgccatcaatttttgcttgctcttcaagttgttttctaaattcttctgtcatcctcatttggtactggggagatcttttttcttttggtgttgacatggtaattaccctaggatattgtgagttacatggtaacgaccattgtagtatcagttatcaaataaggcaacgccccacagtgctcgcaacacatgtagggcgtttaaccaaaccgttagttgaggtaacgattatggctatacaacagcataaccaaactcgccttaaatttacattcctaattgcatcgggcaatcaacgtctggtggatattcaccctgtacgcctcattactgttctggcggactgtgaaggtgaagcccgtttactggcaggcaaatctaatctggtatttgtttcccgtcagggggtggccgcatgagcaagcctatcactattcatcaagccgctgaaaaggcgcagcaactcgaatttattaatcagcttattgagtcataccctcatcaaatacagggcagtgaaatatccgttatgtcttcactgatggcgaagctatccggcgatattgctgtatttctgattgaagtaatcgcaggtgaggaagctattgataacacttcccactgtagcgatatgtctaccgttcagggggtgaaccatgcctaatcctgcccctcatgactattacacccatcagaacggggaaaccgttcaggtgttgtcggtcgcctttaatcgcgtgacgtttgtccgtgatggttatcacaccccgtgcatcatgccagtaagccgtttcactaaagaatacacctacgcagggagagcctgattatgtctgatatctataaccacttagtacgcaacaactttaacgctatgagcactgaggaaattaaagatctgcgtaagcattcagatggagcacacagtgcagtgatggcggcaatgtcagcgatgggtgagttggctttctggtctgctgataatgaaaactatgcaaattgtcaggcaagggaagatttacgccgcgtgggtgaagcactgatgtatttgccgaggattgccgaagcgctgaacgacacagcacagcatgcggattttgaaattcatcaccgtgaggggttccccaaatggtaaatcatattgatatccgttcagtgaaaatggcggctaaggatcactggcaaggattgctgccagcctgtggggtggatgttccggcgaagggtaagcatggcgcttgccccctctgcggcggcactgaccgctttcacttcatggacgatcacggtcacggtgactggcattgtcgccagtgcgatgagccgaatcacggtgatgggctggatttgctggtgagggcgaaggggatcacgattattgaggcggctaaagttgttgctgatgcactggcattgcctttgccagaacccaagccagccagaaaggaagctcccaaatcggaggctcccccgatagccgaaagaattaaaaagctggtggctcaaaccacggtggggcaatccgactatctgactaacaaggggctgcaatgcccccatcagaagctactgaaagacggttctttgttactggtcatgcaagcgttggacggaaccgtaacaggcgcccagacgatcaagccgaacggtgaaaagcgccttgtctcaggctcacagaaaaagggcagttttatctccttatccgaaattaccggaatgcctgacacgttcatcattacagaaggctacgcgacggccttaaccgtcagccagttgcatgatggcgtgatactggctgcaattgatgaagggaatttaccgactgtagccgaacaggtcagggaacggtggccaactgcgaaaatcattcttgccgctgacaacgatatgaagtccggtcataagaatgtggggaaaatttcagcagaaaaagcggctaaatctgtcaggggctgggtcacattgccgcccacggaagagaaagcggactgggacgattaccgccagcgtcacgacatcgaagcggcaaagcaggcattcagtaatgggttgtatcaggtggggaaaaagaaccaatgtcagtggtgattaatttagcggaacaccgtgagaaagaacgtgatcccctgataccgtttattgatgtgcgcaacaccggagttttttacgcgaccccgaaattagacaaagaaaccggggaaatcatcaaacctgaacagtggttatgttcaccgattgacgtgatcggcacgggcattgatgaaaatgatgagcaatacctgatagtccgctggaaaacgaagggtaataaagacccggtcattaaaggggtagcgtcggccgacattggagaacgcgaaggctggcgaatactcaaggcgggcggtgtgcaggtgaccacaaaaagtaatctcagggcgatcctggctgactggctgatacgaagccacacaaaggaaatctggagtatgacggcaaaatcaggctggcataaaggggcgtatatcatgccggacggttcagtgattggtgtacctcagcagcctgttttgtttaacgggggaagcgctgccgcccatgcttacacggtttcaggcacaacggcaagctggcgtgaacaggtggcgcggctggcaaataataacccgttcatgatgctgggcattgcgacggcgttagcggccccgatgatagggattgtgggggcggacgggtttggtgtccatctgtatgcgcaatcgaccgccgggaaaaccacgacagcagatattgccaccagcctatacggtaagccggatgagcaacggctgacgtggtatggcactgcgctgggtattgctaacgaagccttggcacacaatgacgggttgttatcactggatgaagtcggacagggcgcaaaccctaaacatgtccacacctcagcttataccctgtttaacggtaaggggaaaatacagggggcaaaagaaggcggtaaccgtcctttggcaagctggcgaaccgtggcgatcagtaccggtgagaaagatatccccacgttcttgatggaagccgggattaaaattaatgccgggcaattagtcagattgctgaatatcccgatggaaagggcgaaaaccttgcacggttcagaaaatggtaaggcgcatgcggatgctttaaagcgcggctgtcgtgaacattatggtgcggcagggcgggaatggatcggttatctatcgtcacaccatgaggaagccagacaggcttatattgaggcgcaatcacggtggggcaagttgataccggaaagttatggtgagcaggtacaaagggtcagcgaccgctttgccgtactggaggcggctttaatgttggggcgggtcattacgggctggaaagcgcaggattgccgcgatgtgttgcaatatatctttaatgtctgggtggcggagtttgggacaggcaataaagaatttgaacagattgtcgagcaggccgtttcctttcttaacgcccatggcatgagccgctatgcccctctgccctatgatgagcgggacttaccgattcgggatctagccggataccgggaaaagaaaggccttcatgataatgatccgatgattttctataccttacccgccactttcaagcaggagatcgcccggggttttaacgtggatatgttcgcagacacgttagtgaaaagcgacatactcaaaaagccggccagtggaaggagctatcagggcaagacaccccgccttaagcatctggggggcattcagcaacgggcttacatcatggtgttagtgcctgaatcagacgaagaagcctgatcttctcatgtgagggttaaaacctgttgtctcagttgtctcggttgtctcatttttatttttccatatgaaaggtttaaaaccaccgtctttagacggtgactttgactttaattctttgacctatgcgcgtttacgaggtgcgtggttcgacgactttcagtcgtcggcaccgaagtgcgctaacccacctacttcagtaggtggtagttaagtaactgtatgaattgtaattattttagtttttaaattgagacaacatgagacaacaaacaagggttttgagacaacatcaaacgggtaaaagttttctttttggcaggccattggaggcattatgagaaaattacgtaaattataccgtcagaaaatcaatggctttacgggcatgcggttggaacttcacaccttgtccgaagagcgattccatgatcatgagctgaccgacaggattatcctgaatctggtgggggagtgtgcggatgcgtgatattcagatggtacttaactaatggggtgcatgggccagtgaagggaatagtgacgttgactgggcacctattgcagcggggtttaaagggctggttcccagtacccgaaagactcgcgctcaatgttgtgatgatgacggttttgcgattgaagaaatataacccttattatttccagctaatcgtcatgcactatattaaggcgtctgcacttcgggcaatggggacaaagctaggcatctcccataacgaagtatcaaaacgattacaggcagcagagggatttattgaaggcgttctggcggtatcaggggtcactttggagctggataaatgcgtacaaaaagaaatcatcaatagggttgcgtaattacaaaagtcagtatattgtgataagagtgaaagccatgtcacacagcttatcgatttaacaagcctcgcccagtgcgctgagggatccccacaaattagcgctaataaatcaaaaccatgttttggtagattttggcgagatatttgagtgtgttattaagaacgatttcaaataatattagcggggaatgccgtaatacattctccgctaatgtaagatgagagataactcgccttgatttaatactatttgcctgataattaagatgtattcctttattttcggcataaaaaccaatcagccaaagtacaactgaactcagtgtagcaagtagactcaatactgataaacgaccagtaccgtggctataacttgctctaagaccaaatccaaaacgttcactcttttcatccctaaaattttgctctatttgcattcttcggctgtaaattttcataacctgacgaggtttaaaatcatccatactagtaaaaataagccaaggttccattgctgccgaacgtccatctttgacctgagattttcgtaccattcgatatcgtgattttttgaattttctccctttattcggtcttttatgaagataaaaataaccatcgcaacgtgcatattctgcttttgataatgtgccaaaccctaaaaactgtggggttgtagttgcttttaaagcttgccgtttaaaccaaagctcaccctatttttcaagtcttagttgagtatttcctcgaatgcgtccgacgaaatcccaaccgagcgtttttatctgtttgaaccctgcattttgaaaacctgcatccgtaacaataattactctagctttagggttaacagcactcgctagcatgtcaagaaatgcattttggatggttacattttgttgttcacatgagggaactatttgacttaacaaaggaattgagcgtccatcacaaattcaactcgcacggagtacatgatgttcttgtgagggatatccactccaatcaacagctatgacacacaatgagagtgactcagtcagcatagcaataatattacgaaagatatcaggaatatccctatgaagagcttcattaccgagtagccgatcaatacgtttaattttatgtttgacgtgagcgtttcctggtaaaaagcgcccaatgctggttaacgtaagagaagcaccattaatcaaagcgatagtggcatcgattaatgcattctgacgatatttatgaaatggtgataaagcatctttaaagaagttatgacatatttcacgtacaggcatagcagtgaccttattgacttggtggaacaatcagtagatcacacaacgctatgcctgtctattttctggggattcctcagcgcccagtgcggggctttttattaccctgtattcaataaagggtatttagaatcagcagtaaacttcaaatttacaactcactgaatcatgcactcgactaatagacagattttatgatgcgtaaccctattttaatgcgtgttaattttattaatggttattcagttgatataaaagaccaccctaagtaatattaactggcaatttagcagtaggatgaaattacctttaacgaataataaagtgagggatttatgtctgaagttaataagccagaacttaaaggttacgtgatgtcttttgatattggattaggagttagacgactctatttaggcaaggatttgtatgctgaaagagagttggggtattcgaatgatccacatacttatggagccttggatataattacaaacactacattaattagaaatatattatttttcaattttcggggggacgacgaccttaatcttcctctgagtataggtgtgatatcttatccaaatgatgattcaggtcccatatcagcattaggtagacaagatcttgatataacggttgatggtgtgatctatcatcttggctctagtcaagaaatttatgtacaggatggtaaagttcttctttcataccaaaacgcagatgtaaagaaattatttgctatggcgatgcaagcaataggtgaaactaagcgtttttgcctcaactggcaataactcaccctagctccacaccctgaattcaaggcctcgcactcgcggggctttttgctttctacccgtcgtaaatccaactacctaagaatcctaggtagttcaaaatcccgcgagagtcggggtgttcagaggaatatttcaatgcggcaaatagaggaaatagctgaagagatcgtttctgaactctttgcagtcagtaaaactccaatggaacaatttggtattaattggaagcaagctgaacgcttagactcactaaacgaggctcaactctccggtaattccggttagttcaaacttacttattattacttcgatactttttacgtaacctgaacccaagagtgataagataaatggctagtaaactttcaactgaattatatagccagtccactgcaatatcagatgtcatccactttaaaattgataccgcgagtaaaaatatcccaccaaagatgaatgctagaggtgtcttatctccgagtggtaatttttcaaattgtgacatattaaatccttataatatttactgatggttatttgatatgagtttcacatattcggttattccaagcaactgaatactatagttataaatgcttcggtagtgtgagacagtccgactgaactaaatcagccaatctacacaaggtcgtttaatgcggcctttttcatatctggaactttggcgtagagggttcgcgcggatgcctgaagagcattaggactcggttcgattccgagaggttccaccaaattatcgaaggtcgcttaggtggccttttttcgtatttaaatattttcaataaaaacaaaatcataaaatgtttggaatatttttaggaatattttgttgttaccagtacttccgatttcttcccctaatttgagggacgaaaacaagaagtggctatagatcatcaaccaaatttgccgccgcaatcaccctcagtacatccgtatctcctattgcggtcggcatcctaactaattgaaactaatccgatatgggaattcccataacgacctcctattaactcaatcacaggggcgaccatagctcaccccacggacgcccattgttcaaatggggtggaatatgcgtatgccaaacaaagatccgattgaactctaccagtggctgatacttctgctgctttctgcatggggcggaatagtccgctacatcatcgatataaaaaccagcaacgcccgctggagctggattggggcatttgcccaaatagtcgtttcgggatttaccggactgataggcggatttatcagtctcgaagcggggctgagtttatacctgatgttcgttagtgctggcgtgtccggcgcaatggggagcatcgccctaacctatttctggaacagactgacaggtgaacaaagatgagcagaggcattcgcaacaacaatccaggcaacattgaccacaactcagcgaataagtggcagggtcaattgccccatgacccgagtatagaaaagcggttctgtcggtttgaatcaccagagtatggcattcgagcgctgatgaagctgttgtgcaattaccataaaaaaggctatcagacagtcgcgaagataatcgaccgctgggcacccactaacgaaaacaacacctcggcttatatcaagggtatggccaaggcattaggtgtcgatcctcatcaggtgattagtgtcgataaggtcacattgattgtgttggccaagtcgatcattcagcacgagaacggcaagcaaccgtattcagaggcaacgtttgagaaagcgtttgagcttttatgaagtgggaagttaaagctgttgcagtgatagtcggtatcgttctgattggctcggctgcatattccatctattcagtgtatgcggaaaatggacggctcactggtgcgaataaatcattgaccactcggctatcagaacaagtcgccatcaataccaaacagcaagcacgaatccagcatctcgcagaactggagaccaaacacattcgggaactcgacaatgccaaatctgaaattgacactcttcggtctgatgttgccgctggccgtcgcaagctgcggatcaaagccgtctgccccgtgcgtgaaaccactgcctccggcagcgtgggcgacgcaggaaccccacaacttacagaagcagctcgacaagattattacgatctcctccgaatgatggcggagaacgaacggcagacgaagtacttacaagattacgctaacactgaatgttataaggtgaagaaatgacagatgcagaattaaagggaatcatcaaggaagcggtagaggattatagggcggggaatggcgtttactactctaaagaagaagccttcgccctgatggatgcccatattgccaaaaaaagagcaaataacaaattgccaccgcagagcaaatgatactggggttgcaggagccatcctgtctcctgcttgattgttattataaacagtatctagtcgttctatccggattcatcacaagacaggcagctatacaatctgtatatgctatgggtgatagaacaaaaggtaagcagatagtggcataagtctgcatcgaagctaaaagagtcgtacctgctaccaggcaaagaagaagatattttttcataatcattctccacatcttttactacgttattatcacaaaaactggtaaatctaataaacccatcttcccccaataacaagcgaataatacttaacaattagtcaatgcctgaaactaaagtcaatatttctttacccattcccctgagtggttaaaggaatatcccatgccatcagttaacgctggtggcttttctttttggagggcagtacatgccgccacgtatcccccgagcctgccgcaagcagggctgccctaagaccaccactgaccgaagcggctactgtcctgaccatcttcacaccggctgggagaatcaccagcaaggtaagagccgacatgaacgcggctatggcaggccgtgggacaagctcagagccaccatcaaggcgagagacaagcatttatgccagcaatgcttacgcaatggacgggcagtgacaggcgtgaccgttgaccacatcaagcccaaggcacacggtgggacggatgcgttaacaaatctgattctactatgctggtcttgccatagggcgaagaccgcgacggagagactacgatgagcgagaaacaagtcaaattatcaagactgtacaagggtggccacttcaaaggttatgccctgagtgtggatggcatgttgctatcgaaccagcagcaggtcgtgattgagactcacagcagggatattcaccccacactgaacggtaaccttcacagtcagtgatgagatggcaggtgatgttgtcgatattcatatctagcttcatttgttgatcatatcaatggtgatggtgacaatgattgtcatcctgagatgattttaatttcatcagtaacaatagcatccatcagggtcactcaaggggagggggaggtcaaatagctggcactctcgccccaagggaccgcctccctaagtctttttttatccccgcgaaaaatgaaatttaaatcgggagtctttttatccctctgaccctgtttttttgaatccgggaggttctgagtatggctggaacggcgggcagatcaggtcgtcgccccaagccgacggcacgaaaagaactggcaggcaatccgggcaagcgaaaactgaaccgggatgagccggcttttacgcccctgtccggggtttccccgccggactggtttagggaaaacgaattgccgctggcggcggtgatgtgggaactgaccagtcaggaattgtgtgcacagggattgctttgcgtcaccgatcttgccgtgctggagcgctggtgtgtggcgtatcagttctggcgcaaggcggttatcaatattgcccaacagggtaacacggtaaccggcgcgaccgggggaccgattaaaaacccggaactgaccgccaaaaaagaacagcaatccgaaatggacacgaccggctccctgctggggttagatcccagcagccgtcagcgtctgattggggcggcaggtcaggccaaaaccgacaatccctttatgaggatgatctcatcatgagccgcaaatcttatctgaatgtcaatgcggcgaaccaatatgcccgtgatgtcgtgcgcggcaaaattgaagtcggtcgctacgtcagagaggcctgtcagcggcatctggataacctgaatcaggaaaaggcgacatcgtttaagtaccggttcgataaagatcgggctgaacaggccgccaaatttattcaattgctgccccacaccaagggggaatgggcgtttaaacgcatgcccatcacgctggagccgtggcagctatttattgtgtgttccgtgtttggctgggtgcataagggcagccggttgcgccgctttcgggaagtctacaccgaaattccccgcaaaaatggcaagtccgcgatttcggcgggcgtggcactctattgctttacctgtgatgacgaattcggcgcggaagtctattccggtgccacgacggagaaacaggcgtgggaagtcttccggccggcgcggttgatgtgtaagcgtaccccgatgttggttgaagcattcggcattgaagtgaatgcgtcaaacttaaaccgtccggctgacggggcccggcttgagccgctgatcggcaatcccggggacgggcagtcacccagttgtgccattgtggatgagtaccacgagcatgacaccgatgacctttacaccacgatgctgacggggatgggggcacgacgtcagcccctgatgtgggcgatcaccacggcaggttacaacattgaaggcccctgttatgacaagcgccgtgaagtgttagagatgctgtccggcaatgtgcccaacgaggagctgttcggggtgatttacaccgtggacgacggggacgactggacttcgccggacgtactgcggaaagccaatccgaatatgggcgtgtcagtctatgcggatttcctgctcagtcagcagcagcgcgccctgaataatccccggctggccagcgtcttcaaaaccaagcacctgaatatctgggtgtctgcccgggaggcctatttcaatatggtgagctggaagcagtgtgaagacacgacgctcaccttagagcagtttgagggccagccctgttttctggcgtttgaccttgcccgtaagctggacatgaacagcatggcgcggctttttgtccgcgagattgacggtaagcggcattactacagtattgccccgcgtttttgggtgccgtatgacagcgtgtacagcgtagagcagaccgagaaccgccgcaccgctgaacgttttaagaagtgggtggcgatggatctgctgaccgtgacggagggggccgaagtggattaccgctacatccttgaagaagccaaactcgcctgtcacctgaacccggttaatgaggccccgattgatccctttggggcaactggcttatctcactcactggcggacgagggcattaacccggtcatcattacccagaatttcacccacatgagtgacccgatgaaagagctggaggctgctatccaatccgggcgctttcatcacgacggcaatcctatcctgtcatggtgtatcagtaatgtcgtggggaaaaccatgggcgggaatgatgacattgtgcgccccatcaaggagcaaaaggacagcaaaattgacggggcggtcgccctgattatggcgatgggccgcgccatcctgcatgaagaacccgactttctttccaacctcgatccggatgaccttttaatgttatgaaaaatttactgattgatggcgctgcactggccggcaccggggcggtgttggcgggctgttaccttaagtatgggctggcaaacaccctgatcatcgggggcgttttgttgattgcctatgccctgaccgtcgcccgccggaggaaatatgctgcttgatgcgctgttccgcagtgaaccgctggaaaatccccgcaccccgatcacggccgaggctgccgaccatgacggcctgttcagtgcggatgtgtatgtcagccccgaaacgtcgatgaaactggcggcggcctatgcctgtatctatgtgctgtcctcttcggtggcgcagatgccgctgcatgtcatgcgcaagaacggtaagaccgtggaaatggcgcgggatcacccggtgttttatctggtgcatgatgagccgaacgactggcagaccagttacaaatggcgggagctgaaacagcgccatgtcctcggctggggcaatggttactcgtgggtgaggcgtaaccgtcgcggggaagtgaccacgctggaagcctgtatgccgtgggaaacgaccttactgaacacgggcgggcgctacacctacggggtgtataacgaagacggcagttttgccatcagcccggacgacatgatccacatccgggcactcggtaataaccggaaaatgggactcagtcccatcctgcaacatgccgaaaccatcgggatgggcatgagcggacagaaatacaccagtgccttttttggcgggaatgcgcgtccggcggggattgtctccgttaaaggggaagtcaatgataaaggctgggagcggcttaagcaggtgtggaaaaaagccgccgccgccctgcgcagtgaggaaaataaaaccctgctgctgcccgcagaactggattatcacgccctgaccgtgtcacccgtggatgcccagctcatcgacatgctgaaactcaaccgctccatgatagcggggctgttcaatgtgccggcccacatgattaatgacttagagaaggcgacgctttccaatatttctgaacaggctatccagtttgtccgccataccgtgatgccgtgggtggtgaactgggtgcaggaactgaatcgccggttgtttacccggcaggaaagggcggcggggttttatgtccgtttcaatctggcgggactcctgcgcggcaccccgaaagagcggggtgagttttaccacttcgccattacggatggctggatgagccgcaatgaagcccgtgcctttgaggacatgaaccccgtggacggactggatgaaatgctggtgagtgtcaacgccgccaatctgcttaacaacccggatcaaccccatcccaaccaggaggacaaacccgatgagtgacagggaaatgcgctgttacagcggtgaggtgcgtactgaaaccccggagaaccagccgacgcgcattgtcggttacggctcggtgtttaacagccgctcagaaccgttctggggctttcgtgaaatcatcaagcccggggcctttgacgaggtactccatgatgatgtgcgcgggctctttaaccatgatcccaattttattctgggacgcagtgccgccgggacattaaccgtgtccgtggatgaacgcgggctgcaatacaccattcaggccccggacacacagaccatccgcgatctggtgctggctcccatgcagcggggggatattacccagtcttcctttgcctttcgggtcgcccgtgacggggaacactggtacgaagatgaggaaggcattgtcatccgggaaatcagtcagttctcccggctgtttgatgtgagtccggtgacgtatccggcctatcaggcggccgattcagccgtccgttccttgcaggcctggcaggaggtgcgccacagcggggcactccggcaggcgattaatcaaaaaatggcgcgtgagcgcattctgacgttactgaatatttaggatatgagcatgaaattacatgaactgaaacaacgccgtaacaccattgcggcggaaatgcgtaccctgcatgacacaatcggggatgccgcgtggacggatgagcagcgcaccgaatggaacaaggccaaaaccgagctggacagcattgatgcccaaattcagcgcgaggacgaattgcgtcacctcgaccagcagctggttaatcagactgagtccgaacagcggggtcatcctgccccgcctgaaacggcgctggctgaaaaacgggcggcgtctttcgacaaatacctgcgtcacggattgggtgaaatgacccccgaagagcggcaggcattgcgtgaactgtgggcacagggcactaccccggatgaaaaaggcggctacaccgtcccggttcagatgctgaacaaggtggtcgaggccatgaaagcgtacggcggcattgccagcgtggcgcaaatcctcagcacctccaccgggcagactatcgaatgggcgacggcggacggcacgacggaagagggtgagctgctgggtgaaaacacggcggccagcgaagaagatacgctgttcggcaccgagtcactgggggcgaagaaactgtcgtccaaaatcatccgggtgtccaatgagctgttgctggactccggcattgatatggaggcctatctggcgaaacgcattgccgagcgcatcgggcgtggtgaggcccggtatctggtgaaaggcacgggcacgggcagtccgcaacaaccgaaagggctggaaacctcggtcacgggcacggtagacgcggccaccaagtttagctggaaagacatgaacgccctgaaacatgcccttgatcccgcctaccgcaatacggggacgttccgctgggccttcaatgacagcacactgaaaatcatcaccgaaatggaggatgcccagaaccgcccgctgtggttgcccgaaattgccggggtggtgccttccacagtattgggggtgccttacgtgattgatcaggcgattgccgacatgggggcgggtaacaagttcatctattgtggggactttaaccgctttattgtccgccgtgtcacttacatgaccctgagacggctggttgagcgttatgccgattatgaccagaccgcgtttctggcgttccaccgtttcgactgcattctggaagacacggcggccatcaaggcgctggtcggcaagggtacagtgtcagcggcgtaattccctgtgatgacactcacgccgcgtaaagcggtttttttgtgcctgcgatcggtcagggtcgcaggtgtcaggaggcaagatgccttttcccaccgtggacaaactcagacagcaatgccgtatcgacagcaaccatgacgcggaagatagtttgctgaacacttacgcccgtgctgccatccggcgggcagaaaattacctgaatcgccgtctttatgaagaagtcgtgccggacactgaccccgacggattgtttgtttcggacgatgtggaactggcgatcatgctgacggtgggctactggtatgaaaaccgcgaggcgcagaccttatccacgcccctgtgggcgacactggtttaacattgatgcagccatttttcatttcgacctatccacgcccctgtgggcgacaccctaacggattttggtagataaatcatgatgttaaacatcagtgaaaaaactaccaaaattttttcgcaaattccccctttcaaccacagcactctggccatgcccgagggcgtaaattcggcacggtctgtgcctattgaaatctatcaaaccgccatcgcagctatattaatcgccacgtttatatcacggtaatgttcaacaccagcataacttgccaacgatcatcgcagccatcgacctattcgcgcccatgtgggctacacggctaacaatgtcgataataacgctcagttgccgacctagccccgcacaattcgccccgatcaggcttcgcaacgtaacccgggtaaggtatagtctgctttttatggagaaatcatgctgaccaacccatccattcgtcttaacaaatacattagcgagagcggcatctgttctcgtcgcgattccgatcgttacatcgaacaggggaatgtttttattaacggtaagcgagccgccgttggcgatcaggtatttgccggagatatagtgaaagttaacggtcagcttatcgagccgcgtgatgaagaagacttagtgcttatcgcgctgaataagcccgttggcatcatcaccacaatggaagatagtgagcgggataacatcagtgatttcgttaaccacagcaagcgcgtcttcccgatcgggcgcttggataaggattcccagggactgatttttctgactaatcacggcgatctggtcaataagattcttcgtgccggaaataatcacgaaaaagagtacgtggtaacagttgacaaaccggtgaccgatgagtttattcagggcatgagcgcaggtgtgccgatgctgggaacggtgaccaaaaaatgtaaagtgcagaaagaagctccctttgtgtttcgtattacgctggtgcaggggcttaaccgccagattcgccgcatgtgtaaatactttggctatgaagttactaggcttgagcgcacgcgcatcatgaatgtcaacttgaaagggctgccacagggcgagtggcgagatctgaccgacgatgaactgatcgggttatttaagctgattgaaaactcatcgtccgaagaaaaaccggcgaaaaaagcgcagactaagctcgttgcagctaaaaagccgggctttaacgtgccgaaaaacgccgaaaaatccgacggcaactctgcttctcgtaagcgctttacccagcctgggcgtaagaagaaggggcgctaagccgggataattctcgtcagctgccggatctagctaaatcctttaagcgactctcgttgcgggctgacaataaagatttaaacataaatcgccatgagtttgctagacagtacaaaaaactaagtttacaactattttgtaactaattaatggcgcggatggccggtacccttggtgaagagtttggtcttgcagggagcgaaacttttgagtcaggttggatcattgattcgattgatggcacgagagcgtttatttatggtgtgccattatttaatacattaatcgcttatattgaaaacggtgaacctgttgtcggtgtgattggctttccagctatctcaactattgtatatgtcgctcaagggtagggaggctggatgttgtacagtgatctcgatgcgtgttatcgctgtttttcaagcttgttaactgccgcaacacctgaattggcggagcagattgtttgattaatgaatgaataaaaacgatgatatggggtgtcttaccaccccgtcaaatccggatagataaacattgtgctattagctgaaatcaaaacacaggcgtagtttgccgcagtggaggcagtggaatggcagcaatcacagttaacggtttatcggtagaaaatgcccctgttccaatggggggtctgggtgatatttgaaaacaggtaatacttttttattcagtgccatatttgctcctttcgcgggccatatattgagatccttacgccccttataatgatatcgtttcatactgttatgcatgaaaacagggacatttctaaatggggaaaaagtaacattactaaattaacgggcaattgccacattcgctttgatatgtttaaggtgaacgacaatcgtaaaggtaacaaccaccaataatgaccatgccccccattttcctgcatgaacaacagaccaagcgcctaattgattcgggtattgccagatcccaaagaaggtaccgaagttttccgccaaccaaataaaaaaaccaatcagtataaaagcaagtaatagtggcattctgcattcttgatccaacggcgtataaaaaatagtaccacgtgcatacaaaccgaaaataaaagcagttaagtaccagcgataatcatcaatataatgatgactaaagaagttgatataaattgccagtgccaccagtgttgccatccaataaggtgggtaatgctcaatgcgtaccttaaaaaagcgccatgactgtataatgtagctccccacggccgcatacataaaacctgtaaatagtgggactccccaaagcttagtaaacgcagcatcaggatattgccatgaactaatagatgctgatgtcttaaatagctccatcataaaaccgactaagtgaaagacgcagatcgctttcaattcatcccatgtttcgagttttaaccgtattagtaatgcttgaaaggtcactgcaaatactaatagtacatcataacgcggtatgcccatgatgccttttgctggaaccaaaaataaagccaaaaaaaagaaaccggcaaataagcacgagcgtgcattaatcaatccaaagaaaagaaactctaaaataaatcgtttaacacctgtgctgttattgggcttatgagccattaataagttatcaactttacgcagaacattcagtctctggcacatactttccatttaattaacctgttggtgttatttgttgtcaattcactacgataatgcctatttcacgccgcgaattctagcaggatttgagtaaccattcaccaacacctattgaataatcaggttaagcacacccgggtacagtatcgatgcttcagatctttacccgaacgggtttacactcccgttgagttacaacaaatggccgagcatcaaaaacggcaattgatgggtattgccagagaaaaaatcgcaccattacaggacgccgtggatttaaatatcgccaccaatacagagaaatctgcactaaccgaatggcgtaaatgccgggtgctgctcaatcgggtggattgcactaccgcacccaatatccaatggccggaacaacaatcagtgatccgtcggattggttcctgattatatcgggattatggggcgtgatcagaaagtctgccagatgggaaaactcttccgccatcagcttcgcccgttcccgcatataggctattttttgccagcactgtcttattaattaaataataaaatcagtaatatagtgaatttaatttggtcatgactccaaagagttaacctggtattcttatgcctttttaaggggatctcaaaatgacggtgacgatagaagttgcttgccggtattgtaaccaaaccgaaccggtacgcaaacatggagcaggtaaagccgggtttcctcgttattattgcaagggttgccaaaaaaccttccaactcaattatcattacaatggccataagccgggtatgaaagaaaaaattgtcgatatggcgatgaatggctccggtgtgagagacacgggacgtgttttaagtatcggtatcaatacggtaatgcgtactttaaaaaactgtcgccaaaacaggtaacatcaaggcaggttgtttatgatgatgtcaccctcatttgtgaactggatgaacagtggtcttttgtgggcaacaaaaaataacgtcattggttttggtatgcttttgatacaaaaaggaagcaggtcatagcccatgtattcggtcctcgaacagatgccacctgcagaaaactgctcgacttattagccccttttcatattcgtttcatcacgaccgatggttggggaagttacgccagagaagtcgagccagaaaagcatttggtgggaaaaattttgactcaacgtatcgaacggcataatctcaatctgcgcatccatatcaagcggctggcaagaagaaccctttgttattcacgctcaatagaaatccacgaaaaactcattgggacatatattgaaaaatatcattataacgcttgggagtcatgaccgtttgttgataatggtgtttttatattttttcagtagtcactttgcaatggcgggtggtgtagttattggaggaactcgggttgtttacttaagtgataaaaaagaagtttctgtatctgtcaataacttagagaaagaatctgtttaccttattcagagttggattcaggatgaaaatgagaaaaccaaaactccgtttatcgtgacgccccctttatttaagttaccagaaaataacgaaaatattttgcgtattattaaagtgggtgatggattgccaatggatagggagtctatattctggctaaatgtgacgtctattcctgaaactgtaaaatcaagtgcagatgtcaatcagttacagattgttgttaactcgcgattaaaactattctaccgccctacacaactggaagagaactcgggggaggcttataagcatatcaagttcaggaaagaaaatggtgtattaattgcagagaattccacaccttattttatttctctttcacatctaaaagtggacggaaaagaaattgaaggagcgggtatgattaatccctttagccaatcaagttggccatttcctgtcaaaaatgcgaaaaatgtcagttggaaagcaatcaatgattacggtggagtcacacaggaagaactcgcagatctttaggttatttattaattttaattagattgtcagaagattgaatatgtcaaaaaatataaagcataatcttgctaaggaattgtgcgaaggcaagtattatcgattatggctgcctatatttatcatgatagggagtttttcttatcattttaaatcttatgctgaaaatgatttcaacatccatgcgctgagaataggagatgattttcctgatgatatcgatctttctatttttaatacttccaagcaaccccccggtgaatattgggtcgatacctacttaaataaagaaagtattgatacgggaaatgttgagtttattttaaatgatggtgaactgcggccaaaactcactgtgcaaaaattgcgggatttaggggtgaaaatcgatgtttttccggtgttgatgaatttaccatcagaagaggtgattacccaggggttacgcatgaaaatatttagtggataattctttcatttttagagggacgctaatgaaagaattagtggatgtcttttctgattttccagacccacgttgtcagggaaaggtcaaacaccgttttattgatatcttagtgatcgcggtatgcgctgtcattgctggggctaacgcctggactgatattgaacagtacggtcaactcaaaaaggattggctgagttcatttcttccgctcaaagagggtattccgtcacatgatactttccggcgctgtttcagtttattaaacccgagcctctttgaacatcatttttatcaatgggtttctcgtgacctctcttcagaaaaacgggctatcattgcgattgatggtaaaagtttacgtcattcgtttgataagaaaattgaccaaagcgcattacatatggtgagtgcattcacggttgagaaagggcttagcttatgtcaatgtgccgtagacggaaaatcaaacgaaattaaggccattccggcattattatcgatgctttcattgaaaggccatctcgtgacgatggatgcgatgggttgccaacgcacgattgctcagcaactacgcgagagtgaagccgattatattttgtcgcttaaaggcaatcaggggaaaaccttttcggaagcggttaactattttcaacaacaacagataacccaaaaaccttaccttaaacctgaccatgatgaattcgatgatggccacggacgtaccgtcagacggcgcggatgggttctgccactgacatcagaaacaaaacacttaaggtcttggccagatattcaagctcttctggtaacagaaacgatacgacaagaacactattctgacacggtgacttctgactttcgttattatttaagcagttgtcatgattctcccgcctttcagttaggtgcaatacgaaaacattgggctatcgaaaatagtttacactgggtactggatgtcactttccgagaagatgattcacggatgagagagcgggtcgccacaagaatatttgcccaattacgtaaaatggcactcaatattgttaaacgagatatcaatagtaaattgagtttgagtgcgcgaagaaaatcagcgggatgggataacggttatatggaagcactgttatttaatcaattttagccgaccaaaatttcatgcgtaacccctgggtgattaccaatatcagcgaatatattccttcagccagcacgcagtttgattttaatcgacaacggctggatatcagtattccccaagttgcgctgaatcatcaggtgagaggttatatttcgcctgaatcatgggatcagggaatgacggctttattggttaactaccattatagtgggtcaacaaactggcaggataatcggagaactaatcagagcaattatttaaatctgcaaaccggcgttaattggcaggcatggcgtttacgaaattattccacttataccagtcagcgcaaaaattggcggagtatcaaatcgtatcttcaacgtgatattcatgctctcaaagggcagttgatcgttggtgatagtttcacgccttcttatctttttgatgggatagaatttcgcgggattcagcttgcttctgacgaaaatatgctgccggacagtatgaaaggttttgcaccggttgtaagcaggattgctcaaagtcatgctcaggtgacaatcaagcagaatggctatgtgatttatcagacttatgttgcacaggggccatttgtattaaccgatctctatccaaccactaccagtgggaatttagaaatcatcatcaaagaagctgatggccgggaacgccgttttatacaaccgttttctgctgcgcccattatgttgaggaaagacagcctgaaatattcgctgacaatgggacattaccgctcaccctatagccacagccgcaaaccttatttctttcaaggtactttgatctatgggcttcacaataatctcaccgcatatggtggtgtcatgttatcccgtgattatcaatctatggtgttaggttcaggaatcgatttgggcaatttcggctcgctttcttttgatgccacccatgctaatactcaattgctatcagacaaaaaatcccaagggcaggcttaccgactgcaatctctgaaagcgctttcactgacaggaactcatttaactgtggcagggtatcgctattcgactaaaggtttttacgatttcgatgatgccaatcatgctgataacctcaatggcaacaatcggttgtttggccgtatcaataagaaaagcaaactacaagtgcaagttaatcaaataatgggggatttcggcgggttgtatgtcacggcattccagcaggattactgggggcagagtggtcatgaacgtggtctcggtgcgggttataacatgagtctcggtggtatcaattacggcttgaattatacctatagccgtactcccgaccctggcaatcatgatcaattattctcattcagcgttcatgtgcctctcgaccgctggctgaaaaatagttgggccagttacagcttgacttcaggtaaaaacagccccacttcgcaacaggttagcctgaacggtacggtactggaggataataacctgcattacagcctgcaacagagttataccaaccaaggggatggcgtcagtggaaatattcataccgggtataagggagcctatggccggcttaatgctggttataactaccagcaccacggcagacaactgaattacggcgtcagtgggggaattgttgcacacccttacggcctgactttctcccaggaactgggcgaaacggcggtattggttcgagctgaaggcgcaaaaggcgttaaggtagccaataatacgggcgttaccaccgactggaacggctatgccgttgtgccttatgccagcagttaccgaaaaaaccgggttgcacttgatcctcattcttttgctgatgatgttgatattgatatcaatacgcaatttgttgttccgacaaaaggcgcgcttactctggccaattttcagacacgggtcggcagcagggtattgatgtttctctcataccaaggtcagccagtaccttttggtgctattgcgacgctggagaaaccgcatgatctcgacaagtccaacagcacaattgtcagcagtgaagggcaagcctatttcacgggaatgccgacccgtggaaagttacaggttaaatggggctttcagaatgccaaaacgtgtctagccaattataccttgccggaaaagcaaacattatcaggccatcctctatctggcatttatacaatgaaggtgaattgtgaataacaccgtatcaggatcaggcttatgttgattttccatcaaaattcccgttttttactggcaatgattattttgctggtgagtttggttactgaggcttatggcagtgagggaagctgccggattaaagaaggaaggaaacaacatgacttatctgccgtgtttcaaccgaaggtgactatttccagaagcgatatgcctggagccgtgatttatcgacatccggttatttcaaacccacaagatatactggggattcattgtgataaaccagagaaaatatcatggaaatttattggttatacgccaaccagtagcaggaatgatggtacttatgattcaggcgtgcctgggataggcatacggatgtatggttctaatatagaactgattaagacaaaccccaaaacaggcactggcccgattaaaaatggggtgattcaagcttatgtgggttctactattgtgcatacttatcatattcatgatgcattgatcacaactgaaaagctgtatcttggctaaaaagaatattattgtccctatgggatcaatcgggatgtgggaattgtcaggtaatccgcgcactgcgggggaacaagatttcagtattgatctggattgtgacgacaatattcctattacgctaaaatttgagggaaatacagtgtcaaatgacaaccgtatattagcgcttgatcagagagggagtcattttacggccggaggaattggtcttcagattctgtatcaggatcaaccagtcatgataaattccgttttaaaggttggcaccagcctgatgggaatttactcggttcctttcaaagctcactatatccagacaggaagtgtgatcaccgcaggtaaagctaacgccactgcaaagatatccatcatttataattaagtccatgttaccagccataatctccttttatggctggcttgaccctttcttattcatcccttctcttttttctggcagaaaacgcccgattttattggcaattgaccttatgctcccagtttgtaggggaaatattgctaattaaatgacaatttattgaactaagataaagaaatcgtttctacgggtattacgataaagaaagccttatataatgtgccctatttttttgaaccttatttttgatttgaaaggaagttcttgagcatcgatatgtcaaacagcgtacttaaccgccgttgggcggaacttttattggaagcactgacccgtcatggattgcgtcatgtttgtattgcccccggttcccgctccacgccattgacattatcagccgcagggaacgttaaactgatctgccatactcattttgatgagcggggattagggcatttggcgctgggtctggcgaaggcgagtaaagaaccggttgccgttatcgtgacgtcaggaaccgcggttgccaacctctatccctccttgattgaagccggtctgacaggcgagcggctggtatttctcaccgccgacaggccaccagaattaatcgattgtggtgcgaatcaggctattcgccagatcggtatttttgcctcccatcctactcagacgctttcactgccgcgtccgaccacagagatctctgccagttggctggtctctgtcgttgataatggcatgtcgaacttgaaacaaggaggattgcatattaattgcccgtttgctgaacctttgtatggcaatgatgtgatcgcgtatcaagattggcaacaaacattgggagagtggtggcagggaaatcaaccgtggctcaggcagccagaaactcatgttacatctaaagtgcaggattggggcttgtggcagaacaagcggggcgttgtactggctggccggatgaatgcagaagaaggtctgctcgttgcccagtggtcaagaaaaatgggctggccactgatcagcgatgtgctgtcccaaactgggcaaccgttgccttgtgctgacttatggctgaatcatccccgtgctcaggaaattctggcacgggcgcaattagtgattcaatttggctctagcctgactggaaaaagattgttgcaatggcaggctcaatgtcagccagaagaattctggattgttgatccgattgttggcaggcttgacccagcgaaccaccaaggacggaaatttacttgttatgtggctgattggctacgggaacatcctgctgactccacgcaagagcctacttcttcttgggcagatgaattgacctcatggtcagagcaagcacttgaatgtgtcaacgccagattggacgggaaatttggtgaggcggcagtggcgtatcagctgcatcaattactgccagaacagggacagttgtttgtcggtaatagcttgattatccgtctgattgatgcgttggggcaactccccgcaggttatccggtttacagcaatcgtggtgcaagtggtattgatgggctgatcgcaacagccgcaggagtacaaagggcaacgaacaaaccgacgctggcaattatcggggatctttcagcactctatgacttaaacagtctggctttgctgcgtgatctttccgcaccgatgatattgattgtcgtcaataacaatggcggccagattttttcattactgcctacgccagaagaagcgcgccagcgtttttactgtatgccgcaacatgtcaattttgatcacgctgcggctatgtttggtctgaattatgtgacgccacaaagttggcctgaattaaaacaacgtgttaaacaggcgtgggggcaaaaaacaacgacactgcttgaattaaaagtcacagacagcgaaggcgcgagatgcctgcaagagttacggaaacaggtggctgcattgtgaaactcgccagtcaggtatttcattcggataagtcgggaacatggttggtttggctgcatggcttgttgggatgtggtgatgaatggctacccttggtgaatgcttgtaatcagtatgcctcgctggtcattgacctgcccggccacggtcactcggccgatattactgtagcagggggtttcgcagagatgagcgctctcctgaatgaaaccttattcaagcaccagatccatgactattggctgatcggctactcactgggtggccgtattgccatgtaccatgcgacttacggcaaacatgaagggttacggggagtgctggtggaaggcggaaatcccgggctgttttcccaacaggagcgtgatgcgagattacagcatgatcagtgttgggtgcagcgttttcgtgaggaatcaatggagactgtccttgccgattggtatcaacagcccgtttttgccgatttatcatcggaacagcgtgagcaacttatccattgccgcagccaaaacaggggaagccggattgccgatatgttggaaaatacttcacttgggcatcagccgtggctggttcctgctctgcaacaaataaccacacattttgcctacttatgtggggaaaatgatgagaaatttcagaacatcgcgaagcaatatacattgccgttaaaaaccatcccacaggttgggcataacgcccataatggcaaccctgcggcgtttgccgccgaagtgaaccattttttatcactttttggttaaggagattcagcaatgctttatcccaatgaagaaaaattgtacgcacccattgaatggcaagattgctcccaagggtttgaggatattctctaccataaatctgtagatggtattgccaagattactatcaatcgcccgcaggtgcgtaatgcgttccgtcccctgacagtaaaagagatgattcaggcgctggcagatgctcgttacgatgacgaagttggtacgattatcctgacgggaatgggggaaaaggcgttttgtgcagggggcgatcaaaagatccgtggcgattatggcggttatcaagatgacaacggcatgcatcatttgaatgtgctggattttcagcgtcaaattcgcacctgcccgaaaccagttgttgctatggttgcgggctattccattggtggtgggcatgtgttgcatttgatgtgtgatctgaccattgcagcagataacgcgatctttggtcagacaggcccgaaagtagggtcatttgacggcgggtggggcgcatcttacatggcgcgtatcgttgggcagaaaaaagcccgtgaaatctggttcctctgtcgtcaatatgatgcccaacaagcgctggatatggggctggtcaacacggttgtgccttatgcggatttggaaaaagagaccgtgcgctggtgtcgtgaaatgctggaaaacagcccaatggcgttgcgttgcctgaaagcggcactgaatgcggattgcgatgggcagtcgggtttgcaggagctggcggggaacgccaccatgttgttctatatgaccgaagaagggcaggaaggacgcaatgcgtttaacgaaaaacgcctccctgatttcagtagattcaagcgtaatccataatgcgtaaagcaaccttatacccattcagcctgcccatggaggcaggtattattttacgttatcaacgccttaaaacccgtgatggttttctggtgcacttgcaggaaaatgaacggcacggttggggggaaatctccccgctacccgaattcagtcatgaaactctggaacaggccaaaaatgctgccgtgacatggctgcaacagtggtgtcaaaacgaacagggattaacggtagaacccgaagagagtgaactgccttccgtggcgtttggtatcagttgtgccctcgctgagctacagggtgaattacccggagatgctgattatcgcaaagcaccactatgtacgggcgatcctgatgacgtgatttggcgtctgggaaatatgactgggcaaaagatggctaaagtgaaagtcgggctgtatgaagcggtgcgggatggcatggttgtggatgtcctgctggaagccgtgcccgatctccagttgcggctagatgcgaatcgcagttggacacgcataaaagctgatgacttcgcaaaatatgtcaatcccgattaccggcaacgaattgcttttcttgaagaaccttgcaaaacccgtgaagaatccttggcatttgcccgtgatacaggaattgccattgcatgggatgaaagcgtgcgtgaaacggggtttacggtagaagcacaggaaggtgttgcggccattgtcatcaaaccgatgctggttggcagtattgtccgttgtcgtcagttagtttctgatgctcatcaggccggactggaagcggtaatcagttccagcatcgaaaccagttttggtctgacacagctcgcccgtctcgcgcattggctgacacccgatacccttcctgggctggatacgctggatctgattcagtcacaactcatcagctgctggccggaaagtcccattccctgtgtggcgctagatgatctggacaccgtatggagcaatgaatgtcattagcggaatgtgcgcaatggccgtggcatcattgggcgatgctctacccagagaagcgggccgtcaggctgcatgaagagacgttatcctggcgacaattagcggaaaaaatcaacgccatcgctgcccattttcaccaacaggggctgtgggaaagtagcagtgtgatcctgagaggaaaaaacagtgcggatctcctgctgtgttatctcagtgcattgcaatgtggcgcaagagtattaccacttaatccgcaactccctgagcctttgttggaggaattgcttcctcgtctgaacatgacatttgtcatcgattttaccgattccccttcatctgctattcaggcgattaaacttgattggcaacctgaattatccgtgataccagagcaatgggtgccgtgggatagccatcgccctgccagtatgattttgacttcaggcacctctggattgcccaaggcggcagttcactctattggggctcaccttgccagcgcacagggaattctctcctgcatgaattttcagccaaatgacagttggctgctttcgctcccgttgtttcatatttccggccagggcattctttggcgctggctgctgaaaggtgcagaattagtgttgcgagatctgcatctattggatcgtgcattatctggctgtacccatgcgtcacttgtaccaactcaactctggcgtttgcttgaacagtcgcttgaacatgaactcactttaaaagcagtgctcttaggtggagcaatgataccaacggcattgactcaacaggctgaacaacttggtattcattgctggtgtggctatggactgacagaaatggcgtcaacggtctgtgtaaaacgggcagatggtttatcaggggtgggaaatccactaccgggcaaggatattcgcttggtggatgaagacattcagatccgcgctgacagcatcgctatgggttattggcttgatggaaaattgaagccactggcagataccgatggctggttttcgacccgtgaccgaggaatattcgaacagggcgaattgcgtattttagggcgcctcgacaatcaatttttcagtgggggagagggggttcagcctgaagatatagagcggattattaaccaacatccccagatcctgcaaaattttgttgtacctattcctgatagtgaatttggacatcgacctgttgtggtgattgaaacccaatatcctgcacttacggaaacacttgctgactggcttgctgataagctcgctgcatttcaacgccccgtggcttgttatcttctgcctgtacaattgaaaaatggtgggataaaaacttcacgccagcaggtcaagcaatgggtgctggaaaaatgggttatgtctaattaatttataaacctgatgatgtataaagatgcagggatatatatattttgataaatttagatatttacttacgtgcactatctatggtgttacttggatttcagtaaaatatctcagatagtattggtattcaccccttgggaagagaagaatatgaaaagtttcattgctgtcagcgtggtcagtttgttttttgtgtctggcgcggcaaatgcaatttccatgaatgtacaggctggaaagcattacacaagtacatctgtggggctaggtgataaaagtgcgggattatctttgaatggaaactggactcgcagtgatcataacggccaaattggtagtttgggcaccgctttcgctctgcctgtaggcccaataacggcaagcgttggtggtaaagtgctttatctgtcgccaaaagaagggaaagatggcgtcgcgttagctgcgggtgccggccttagctgggcggtgttgccttccttgtcactgtatggtgaagcttatggagcaccatcagggctgacatcaggcgttgattcttatacggaggcaacagggggtgtccgttatactttaattaggccgctgattgtggatgctggttatcgtgttattgatttgaaagggaaaaatggtaaccgtagcaataaagtttcagaaggtttttatattggtgccggtttcagcttctaataaacctatacttaatagattttagtttgcagccaacaaagcagcaacgtgaaagatggaaagtataatcgagatcatccgcatcgttcatcgatgcggataattttatgaattaccctacttcaggcagtattccagcgacaatgccaatctgaatggcaattagaatgataccacacaggaaaaccacaactaatgcgggggttccgccaaagacccgatattggcgcttatgctgctgacgagctttgaataccagaatactcggcagtaacagcgctaaaattgacagtgcagcagctgcatagcccaaagccattataaaacctttgggataaaacaacgcaaaaaccagtggggggacaaacgtcagcaaccctgtctgaaaccttcctgctatattatcctgacgtttgaacagatcagccagaaaatcaaataagcctaaggcaacgcctaaaaaggatgtcacgagtgccagattggcaaacatccggacagataattctgtctggggggaggccacaacatgacgaatggcgcccaataaaccatccagaccggatttttcggctaatattcccataaatgaggtgggagcaatgctgcccaaagtacccaattgccagaaaatataagcggctaatggaatggcactaccgatgataaatatccagcgtaatttacggatatctcctttcatatatcgtacgatgctgggcacgctgccatggaagccaaatgaggtgaaaatgacaggaatagcagataacacaatgccttgttccaagggcagggataacaagttgacatggcgaatatggggcatcatcaggccaagcatcagtaccagaaagatcagtttggcgctgaataagatccggttaatgaaatcgacggaactggttccaatgcagacaacgcctccggcaactatggtgaataaaatcacgcccgttgacaatgagagtgaagaacctgcccatgcattaatgctactggtcagtaattcacctgcgccactgatataagccgatgttaaggcatacatcagaaacagcatactgaatccggtcaataattgccctttcaaaccaagatagtgttttgcaatggttcccagcccagtatcgggttcattgtattgatagacttctaccagcaggagagctgtataactcatcaatgcccacagggcgactaacatgaccagtgttgttccaaaacccacacctgccgaagctagtggcattgccagcatccccgcaccaattgtcgttccagcgacgataaaaatactaccaatagtgcgatttttcacgcgatcctcgcttctgaatatgttgaaaaatagttataagattggcaggttaaaggattgatttatagctgtcaaattcagattacatcaagtgtaaataattaattacatgcttaaatgcggctggatgaagataccgctcgtgataggtgatacaaattcggtgtcttctggggggattgactgaactcttttaacttaactgtacagatatttttttgctatgtgaatgttagtgtttttatctaattattcaatataaaaagctatcataatttttgttatggacataaaattgctaaatataattattatttattataaatcagatggttgtgggtttattttaaatttaaaaaacacgttaaattgattattaaaaatgtgagtggacagtctgcttttcaggatttattttcatttggatggaagagagaggctggaatttgggagacacatagcaagtaggagctatggtatgaaagtacaggtaacgtaaatgccgaaaaataaaaaacccgctatctgaaagataacgggttcttatatggtgccggctaccggagtcgaactggtgacctactgattacaagtcagttgctctaccaactgagctaagccggcgaaatttggcggaaggatagagattcgaactctaggatggtttcccatcggcggttttcaagaccgctgccttcgaccgctcggccatccttccatggcgcgagattatgcctataccgttctgatgtgtctagtccctgaaggaaaaaaaatcgtgttttttttactgtttgctcaatcttcgatctgcaatggtctttttattctctaacctgctagtattagcatgatacaacggcttatttgattacgggttgatgtagaatcaaccaaaaaatatattcacactaaaggcaattattcaaagaatgtataaacaagcatctatcaagccatccactattccccgtttttacgcgctatttgttattttgctttttacgtctctatttttattcgggtataactattttgatagttggctcacggagaaaaaatatgctattagcagcgtaactgttaagatgagattgcaaatcgaaaattatcgttatcacgccaatcatatctttgagcaatctaatattccgtcctcttcctcctcctctcaggaggcaacatcattatttaaattgcgtcccgatgtccattggctggaaagccgttataagactgtcgatgcaattatttttggtcagtacaatcattcaagtattcaactagctcagcggttgtctaactatctggaaattctctggggttcccgtaatgaatacgaatctatgtattacctcaatggtaaggataacaatttacttttggtaacgactcatcctattttaaaaccagaaatcaggtttaaggagagttatctgaccctgacgtctgaggccaaacgaactgaaatgttggctcaatcgatagcgctggatgaaaaagaaagcatttcagccatcaatgtgctgcgtggggagaatatttatttctatacttataaagctgcattcaatttgcctgggcaattaactaccgttattgcctttgaactgcccattaataatcttttgccgattgatatgtcaccggcaaactttcgcttgaacttgaccaactcgcatgatgccgagggctccaataaagttgaggtttcactgaacggtttttggctagagttctcccagcatctcaatgccatgccatataaattggtttatcaagtccctctgaaagcactgattatagatttactgatcaggaatatctggctcctgctctcaatattacttttctcaatgttctcattgagtggtttgttctatatccgccgtagatatatcacacctaatgcttcgatggatcatgagttgaaaattaaggactctttaggtaatgatatcatttccaatattcctatcggtttgttgatctacgactttgcatcaaatcggttaatcactagcaataaaatcgcagaacagctgataccttatcttgatttgaataaagttaaggcgatggcacaacaacatcatggcgtcattcaaacatctattgacgacgcgatttatgaagtcaaaatgtataacagcaatctattaccagagacatatctctttctgctgcaagatagagatcaggaggtcatgataaatagacggctccagtttgccaatcgagaatatgataaaactgttcaggccagacgctcaatgctatcaaatattaataatgaaataaaaataccgattcagagcttaaatgagattgctgtccaactgcaacagagatcacaagatgaaagcatgcagaacttgctggataagttattggttaaatcggaatatatcaccaaatgggttgaaaacatttcattactcaatgagctagagtctggtgactggcagtctgctactgaaatattttctctgtcttcacggttggagcatattctgaaagcttccctgtcgacattaaatgccaagggattgaaaacttattaccattttaatcttcatcatgaatctttgttcattggtgatggtgtggcaataactaaaatcatctcgctgttatttaattacgcaatagcggcaaccagttatggaaaaatatcactgtctattaatagttctggtaaatatgacaattacattcaaattgatctcattgataccggttcaggtcttagcgaaaaagatttaaccagtttgaattatcccttcttgaacaagtcagcagaagataagtattatacgaactctgggctaactttttatctatgtaatcaattgtgcaaaaaaatgggagggaattttgaaattaaaagtaagttgggtttgggtacacattatgtcatcaacctgcctcttttgcagcatagtgataacaatggcgaaacgcctcagcttttggaggacgtgacggctttaattgatatcagtaaccctgaaattagtaaaataatccacaattacttgaataattatggtgcgtcatacttcgataaaatcaaagagaatgttacagaagaatacgatattatccttacagatatgcagtacaaagtagaaaaaccaactatattattagtcgatggtttggctgacttgaagaaaatgaaacctaatctggttcagtgtaattataattttgttgatgcggttatcaatgcaatatcgttactggttgaggaaaatttcagtctagatgaatcttgctatgctcttgaaacccctaaatcagaatgcaatattgtcaacagtgttgacaatattctcaagggttaccaaacacagttggcagatagtgattataggaaattatttatagagacagtaccgatggatattactaaactgtatactgatatggaacgacatgatttgacatcactttcgcaaacggtacaccgccttaagggtgcgtttgctatgttagatttaaaattgctcaaatcatcatgtgaggcgttggaacaacacatagcagacaataatgaaatagaaatcaaaaatagcatcagccgtattgattcttttgtcacgaagctgttgcagcaaggtaaccaataatatgaataaccttaatgtcattattgccgatgaccatcccattgttttgtttggcatccgtaaatcactcgaacaaattgagtggattaatgttgtcgctgagtttgaaaattcaacgacactcattaacaatttaccgcacatagaagcggatgttctcataacggatttgtcaatgccaggtgacaaatacggtgatggtattaccctgataaagtatattaaacggcattacccaacactggctattattgttctcactatgaacaataatccagctattttaagcgctgtgcttgaacttgatattgagggaattgtattaaagcagggagcacctactgatttgcccagagcactttctgctttgcaaaagggtaaaaaatttacacctgaaagcgtttctaaattgctggaaaaagtcaatgccaatggttatggggataaacccttgtctccgaaagagagtgaagtactgcgtttatttgctgatggtcttcttgttactgatattgctaaaaaacttaatcgtagtattaagaccattagcagccagaaaaaatcagctatgctaaaattgggtgtagataacgatattgcgctgcttaattatttatcatctgtcactattgaaaaagatattggtagataatcaatatgttatctattggataataaaaaatcggtaattgttgttaccgattttttattatccaatagataaattaattcaagattaaatatcactgtattctattaatgtatcccttaatattgccaatgagacgggttttgatagacagtgatccattcctgcatccgtacaacgttgtttttcttctgccagggcgttggcagtgatgccaatgatggggctggtatatcctttatccctcaggtattttgtgaattcatatccgtccatatttggcatattcacgtctgtcagaataatatccgttgaattatttttcaggtgctcgatggcatcaataccatcattcgctgcggctgttttgaatcctattgtatttaattgttcgatcaataagtgtcggtttaaagggtgatcatcaacaaccaagatcttaatggtactcaaccggctatctgcctgaattgatgttgacgttgatatagtggcaggagagacatgattattttttgatagcagtttatcgatgacactgtcaagctcgctgagttgataagtgttatgtaaccaataatgttctcgaatttgttttggcggcccaatatgtttttctgatatctctatgtagtaacgtacagtaatgtctagtacatcaggctggtcaatgatcactagttctgtgccatctattttatttttgtcatataaggcaatctgaaaatagttcttcgtaagaaaattctgtaaatatttttctagatagtcattgcgaacagccagtacgattttttgttgagtacgattcttggaatactctttggtatgatactttgctccatacagtggaaggcggatagaaaagatactaccaatatgctgttgtgaaacaaattcgatatcaccatccatcaaattgatcaatttttcacaaatcactaatcccaatccagtaccttgcgagaagttttgtttattggcgttgatttgaaaaaatggttcaaacaactgagtttgtaatttatcttcgattccaaacccggtatctttgatactgatatacaggtaactatgctttatcgaaatggtaatgacaacacagccagtttctgtgaatttaattgcattattcagcagattggagatgatttgctgcaaccttacgggatcattattgataatatcgggaatgttcggttcaatatagcagtataatcccaactcttttttcacaatgagaggaagataatttgagatcacatgcaatacgatttctttacaagagaatttcttggaatcaattttgagctgcttagattctattttggaaaaatcgagaatatcgctgatgatttttagtaacagtgatgatgcgttatccattgctgatagcagccgtgcagattctaatggcaatgtatgagattgcagcagttccagattaccaataatgccatacagtggtgttctcaattcatggctgactgttgccagaaacatggattttgcctgattagcctgttctgcggctgacgccatttcctgtaatgattgttccatttttacccgtgtactgatatctactagtacacagattgctacttcttcatttcgataacgtgaatgtacaaagctaatttgcaggtgattgttgttactggtgacaacatcgatataggtgctggttttatcgcagataatatcaacgatgcgtttttgatcttcatatgttagcattcgggtgtaattatgcgccagttcgttactgagaatattggcaccatcattaatccgtaaaatactgatgccaactggtgcagaggcaacaattttatggttaaattgttcatgctcttcaagacgaatagcattgtcttcagcaggggcaaatattttacgttcaaatagccagacaaagaaaataatcaggatcgcagaaataatattcaatacgatactgttaataattgttaccttgaattcatcatagatattttttaatggcaatgaaaaaataacgttaaatgaagaaggagctaagcgtcgttttaataataaattggtataaccctcgtcataaccaaaataaggggtctgtatattatagtcagcgtaacgaagtttattatcattctttactggataatataactcaggctgattatagtggtttagcattgtgatagaaataggtcgatttcttgtttgtagaaatgaatctaacctgatagcttgttcgatacctatcactgctgtcatttgcccattagtatagatcggcgcaagaatataaaaagtaccactgtctgctcttgtgttaggcatgacccaaaagacattccgttcttttccttgttctttcaaaatgattagtttacggaaattttcgtagaccattttcttcagtgtttcaggttctgttatggtactgcgaactgaaaagctcaccatacacatactttgtgtaccaaccagaaagatctgattcaggcctcgtggagcggcaatattatctttccaaaataagatcaggttatttaatgagtctaaataattatgtgtgcttttacgtaagagatcacaatctgaattcatattcagaggagtatatgaaaaagcagggttattatacggcagagtaatagttagatctttttcattcttttgtgataaatgtttctccgtcatatgttggatatcccgcaaggtgttggtagtatgccgaatataagagaacattgtatcgtagttagtgttatattcttgacgaatgtctgatttgacttcattaaaaatatttaccagataaaagctggttaataaggcgcctaatgcccacagcataaagccaagcacccgaaaaaggtaacgggatatctttagtgacgtttgaaaagaagatagatatctcaaaaggtcgcctgatgaaaaacatgattaataataactattcacagcatatactagtgtagcagggaatacaaagcagcatttggttcttgtaagttctttgtaaaaaaattgcacaaaaaaagcaggcattaaaatacctgctttattaatagttttatagaatagtcaaggaaaggtatatgttatacctgatcttctgactcgctattcccttcatcagaaggagacgttatattattttcttcgtcttcatcttcatcaggttcagcaacacgctgcaaaccaacgaccttttcatcttctgctgtacggatcaaagtaacaccctgcgtgttacggccaacaacgctgacttcagaaacacgggtacgtactagtgttcccgcatcggtgatcatcatgatctgatcagtgggttcaacctgaattgcaccgataacattaccgttgcgctcgctgaccttgatagaaatgaccccttgagtcgcacgggatttagtcggatattcgctctgagcagtacgtttgccgtagccattttcggtgacagtcagaatttctccttctccacgagggatgatcagagagacgactttatcacctgcactcagtttgataccacgaacccctgccgctgtacgtcccattgcacgcacacctttcacacggatagtaccgtcttccagagtctcttcatcttcttcgaggaagcgaacgactttacccttcgcagagaacagcatgacttcgttgctgccatcagtcaggtcaacaccgatcaattcatcaccgtcatttagttttaccgcgataataccggcactacgtggacgactgaattcactgagtttagtcttcttaacagttccactggcggttgccatgaagatattcagcccatcttcatattcacgtactggcaagatggctgtaatgcgttcttcttgctccagtggcagtaggttgacaatcggacgcccacgcgcgccacggcttgcttccggcaactggtagactttcatccagtacatcttacctttgtttgaaaaacagaggatagtatcgtgtgtattggcgaccagtaaacgctcaaggaagtcttcttctttgatacgtgctgctgatttgcctttgccgccacgacgctgggcttcgtaatcagacaatggctgatatttcacatatccctgatgagacagcgttaccacaacatcttcctgattgatcaggtcttcaatattgatatccgctgagttttcagtgagttcagtacggcgggcatcgttatattgatctttgatggccagtagttcttcacgaatgacttctcttaaacgttctgggttttccagaatgaaaagcaattcgccgattaatttcagcagttcacgatattcatcgagcagtttttcatgctccagaccggtcagtttctgcaagcgcagatccaaaatggcctgtgcctgctgttcggtcaggtaatatttgccgtcatgaatgccatattccggctccagccattcagggcgtgcagcatcatcaccagcctgttccagcattgctgcaacattacccagttcccacgcttgggcaatcagatttgctttggcttcggcaggggttgatgcccgacggatcaattcgatggcagaatcgatattgaccagtgcgatagccagtgcttcaaggatatgtgcacgatcgcgggctttacgcagttcaaagatagtccggcgggtaacgacttcacggcgatggttgataaacgcggaaagaatatctttcaggttaagcagcttaggctgaccctgatgcagagcaaccatgttgataccgaatgaaacctgcaactgcgtgagtgaatataggttattcaggacaacctcagccacggcatcgcgtttcacttcgataacaatacgcatcccatctttatcggattcatcacgcagtgcgctgattccttcaatgcgcttatctttcaccagctcggcgattttttcgatcaaccgggccttgtttatttgataggggatttcattgacgataatggtttcgcggccatttttttcgtcagtttcaatttttgcgcgggcgcgaatataaattttaccgcggccggtgcgataggcttccagaattccgctgcgcccattgataatggccgctgtcgggaaatcaggtcctgggatatattccatcaggccttctatactgatgttttcatcatcaatataagccagacagccatcaatcacctcagataagttatgaggaggaatgttggttgccataccaactgcaatccctgatgagccattcaccagaagattggggatacgggttggcatcactacggggatctgttctgtaccatcatagttaggcacaaaatcgacagtttctttttccagatctgccagcaattcatgagcaattttcgccatgcgtatttcggtataacgcatcgcagccgcagaatcgccgtccactgacccaaagttcccctgaccgtcaaccagcatataacgcatagagaagggttgtgccagacgtacaatcgtgtcataaacagcgctgtcgccatgcgggtgatatttaccgatcacatccccaacaacacgggctgattttttataggatttattccaatcatttcccaatacattcatcgcaaaaagtacgcggcggtgtactggcttcagtccatctcgaacatccggcagtgcgcgtccaacaataacggacatcgcataatccagatatgagcttttcagctcttcttcgatattgaccggtgtgatttctctggcaatgtcgctcatggagccactatccctcatactccgaattcaaaggcttaaattataccacaaattgacagttttataaaaaccagatgcgggtatttcaagattaaggcatgtataataccctcttatcacacatccccataatactgttacactttctgtggagcagttttctatgaagcagttcctaggagcgatatcgctgatgaacgtcaaaatccccgattcacacatcccgtctcaccccaatgtggatcaacaggaaatcgaaaaatttgaagccgttgcttcccgctggtgggatcttgaaggtgagttcaagccattgcaccggattaacccactgcgtttgaactatatcctgcaacgtgccggaggtcttttcggcaaaaaagtgctggatgttgggtgtggcggtgggattctgtcagaaagcatggcgcgtgaaggtgcggatgtgacggggctggacatggggtttgaacctttgcaggtcgcccgattgcatgcactggaatccgatacttcagtcacttatgtgcaggaaacggtagaaagccatgctgaacagcatctgcattcttatgatgttgtgacgtgcatggagatgctcgaacatgtgccagatcctgaatccgtgattcgcgcctgtgccaaattggtcaaaccgggcggccatgttttcttctcaacgattaatcgtaatcgtaaagcctggctaatggctgtcattggtgctgagtatattttgaacatggtgccaaaagggacgcatgatgcgaaaaaatttattcgcccttctgaactgattggttgggtagataagactcctctgaaagatcagcatattattgggttacattacaacccgctgacagacaaatttcgacttggacacaatgtagacgtgaactacatgcttcatactcaatcggtttaaacgtgacagttaagggattaataaaacggcaaatagatattatttttaagattttatttcccccgtttcgccgatagttttgtgaaagtaacatcaagtaactacgcaggttatcggcttttcggcaaaattaatcctcaagttatccacaaaacttccccgttttgtgcacttgaaaaaatgcggatttaacagtatcttgttattaccgttttaattaccccctatatattgtgtttctcgacgttccgttgctactaattctcgattggcctttagccatttcgggtacatcgtgctgtcaatatgtcaatgtcaagaaaggcgataaaggcgagatacgataaagagaaggtgtatttccccatgaaccagagtctgctagtaaccaagcgtgatggacataaagaacaaattgatctggagaagatccacagggtcgttgcctgggctgccgaaggtctgaaaaatgtctcagtgtcacaagtagaactgcgttctcagattcaattttacgatggcatcaaaacagccgatatccatgaaaccatgatcaaggcagcggctgatttgatttctggcgatgcgcctgattatcagtatctggcggctcgtttggccatcttccatctgcgcaaaaaggcttacggtcagttcgaaccacctgctctgcatgatcatgttgtacgaatggtgaatttaggcaaatacgacaagcatttgctggaagactattccaaagaagaattcgagcaaatggacagttttattgaccatttgcgtgatatggatttctcctatgcagccgttaagcagcttgaagggaaatatctggcacagaaccgtgttaccggtgaaatttatgaaagtgcccaatttctctacattctggttgcagcgtgcctattttccacttatccaaaagaaacgcgcctgagctacatccgtcgtttttacgatgcggtttcgacgtttaaaatttcgctgccaacgccaatcatggcgggggttcgcacaccaactcgccagttcagctcctgcgttctgattgagtgtggtgacagccttgactctatcaatgcaacatccagtgcgattgtaaaatacgtttcccagcgagcgggcattggtgtgaatgcaggccgcatccgtgctttgggtagcccaatccgtgatggtgaagctttccatacgggctgtattccattctataaacacttccagacagccgtgaaatcctgttcgcaggggggggttcgtggtggtgcagcgactttgttctatccgctgtggcatttggaagtagaaagcttgctggtactgaaaaacaaccgtggtgttgaaggtaaccgcgtgcgccatatggattatggtgtgcagctcaataaattgatgtatgaacgcctgatcaaaggggaagacattactctgttcagcccatctgatgttccagggctgtatgatgcgttctttgcggatcaagatgaatttgagcgtctgtacactcagtacgaaaatgacgtcactatccgtaaagaacgcattaaagcagtggagctgttctcactgatgatgcaggagcgtgcttcaaccggccgtatttacatccagaacgttgaccattgtaatacacacagcccatttgatccggcggttgcacctgtgcgtcagtcaaacttatgtttggaaattgcactgccaaccaagccaatgaataatatcaacgatgaaaatggtgagattgccctgtgtacattgtctgctttcaacctgggtgccattaataatctgacggaactggaagaattagcggaattggctgttcgtgcactggactccttgttggattatcaagattacccaatcatcgcggctaaacagggctcaatggggcgccgtacgctgggcattggtgtgattaacttcgcttattacctggcgaaaaacggtgtccgttattctgatagtagtgccaataacctgacacacaaaacatttgaagccattcagtattacctgctgaaagcctcgaatgggctggcgaaagagaagggtgcttgcccgtggtttggtgaaaccacttatgcacagggtatcctgccaattgatacttacaaaaaaacactggatacattgacccgcgaacctctgcatatggattgggaagccctgcgtaatgacatccggcagcatggcctgcgtaactcaacattgtcagcattgatgccgtcagagacgtcttcgcagatctccaatgcgaccaatggtatcgagccaccacgcggctatatcagtatcaaggcatcaaaagatggcatcttgcgtcaggttgtaccggaatataaccgtctgaaaggggcttatgagttgctgtggcaaatgccgggtaccgatggctacctacagctggtggggatcatgcagaaattcatcgaccaatcgatttctgccaatactaactatgatcctgctcgtttcccgaacggcaaagttccgatgaatcagttgctgaaagatttactgctcgcttacaaatatggcgtgaaaacactgtattaccacaacactcgtgatggagcggaagatgttcagggtgatctggaagaagtcgttgagtctgctgattccgattgtgacggcggcgcgtgtaaaatttgatttgaggaagttatgtcctataccactttttcacaagtaaaaaatgatcaactacaggagccgatgtttttcggccagcctgtgaacgtagcgcgttatgatcagcagaaatatcctatttttgagaagctgattgaaaaacagctttcgttcttctggcgtcccgaggaagttgatgtttcccgtgatcgcattgactacaatgcattgccggatcatgaaaaacacatttttatcagcaatctgaaatatcaaacgctgttggattccattcagggccgtagtccgaatgtggcattcctgccgctgatttccattccagaattggaaacttgggttgaaacatggtcgttttcagaaacgattcattcgcgttcctatacgcatattatccgtaatatcgtcaatgatcctgccgttgtatttgacgatattgtagccaacgagcagatcttaaaacgcgccaaagatatttcggggtattacgacgttctgatcgaaatgactaactactatcatcagctgggcgaaggtacatacaatgtggcgggtaaaaacattacagttagcctgcgcgcattgaaaaaacagctttacctgtgtttgatgagtgttaacgctctggaagctattcgtttctacgtcagttttgcgtgttcattcgcttttgcggaacgcgaattgatggaagggaatgccaaaatcatcaaactgattgcgcgtgatgaagctctgcatttaacgggaacccagcatatgctgaacttactgcgctctggtcaggatgaccctgaaatggcagaaattgccagagagtgtgaacagcagtgttacgatctgtttgtgctggcggctgaacaagaaaaggagtgggcagattatctgttcaaagatggctccatgattggtctgaacaaagagattctgtgccagtatgtcgaatatatcactaatatccgcatgcaggcagtgggtttgaagctgccatttgaagctcgctccaacccaataccatggatcaatgcatggctggtttctgataatgttcaggtggctccacaggaagtcgaagtcagctcttacttagtcggtcagattgattcggaagtcaatgctgaggatctcagcggtttcgaactctgatatggctgattacaaagttaccctgccgtcacggcagggtttatccgtccattattcttctggtttccaccgtaacctactggaagccttggaacaaggcaaagtacagcttgaataccaatgtcgtcagggatattgtggttcctgtcgggttcgtttggtgaaaggaaaggtcggctatccctgcaagccattggcatttgttaatgagggtgagatcttaccttgtagttgccatccactcactgatattgaaatcgaaccgtgatcttcctttaattgacggtctctatcgcaattttatattctttaattaaaaattattttcataaagagtgattttttatgaaatcataatatatagaatcctaaatattaatctattattaatagaaccgacattccgcaccactttcaggaataaaatgattcatagggttgccccaatattttcagcagttcattttgatacatctgtattcccgtcaccatacggtgttcctgaaactcgaaagtactaatcccttcgaaggtcaaaaacacccaacgcgccgtgggagattgggtgggtttacctttcatatcgggatagaacggggcattttgcttcagtccggtgcggattttatgctccagtgcagcataaaccattaaactgcatgtcattatcattaataacgccttcgatgcgttctggctttttcaaataaatcgctgaagtcagaaactccggacttttcaggaaacggaaaccccgctcgactttttgttgcgctttgtaattagccagcagagtttccatattcagcgccttatcgtccatttcattcgtcgccagaatgaacatgccgactttgaggcgggcataagccactttccccagttggctgtagaccgaggcagaaagctgataatgaacactatcgggatgttgacctttagccgggcggcctcgccccttatgcacctcgattttttgaactttgggggcctcaatgccgataaactggcattctgcttcgaagtcacacaatgcctgcaaagcatcttcaccacagggaaacgactttttgctgagtttttcgaactgtttcagttctttttccgtcgaaatccgcgtatttttcctgaaagtctgatgttcacactgcatcgccgcttcactgttgaccagtaaccagcgctgtggaacgcccccgtagcaagattcaatccaatgaccggcataaccttctgtaaccggttgtaactggtcggtattaaccgtcagcaggtgctgtttcgcctctttaatggttaacggaacccgggtaataaatttttgattttgttgatgaagtgaggccagtgtctcttgggtataaagcgcggcatcggcaatcagataacggctgttttgggccgctttcaggcagccaatgtgatgtttcgtcgtctctgcaaacgctttggtgtcgttggtgtttccgctcatcgcctgcatgtatacggggatccccgcctgattttcacagataagttgcagcacaacctgattcaggtcaggacggtgatcacgactgtaaccacgcaccaaaacgaggcgttttgtctcgtcatcatcggggagtttgtactcaccatccacgtgaaaactcgtgatatcaaggtgaacggaatcggattttaatgccaatttatcaataacccgctcagcgataacctgataaatttcagagacaccgcagtcaaacaaagcgtccagcgtgcggccgagcacatcatcattgaggtgttcagccataattcccaccccaatcaggcgttcaacgggtttgtgcttaaaaaaatcagggcacatatggagcgttcgactgtggaaacccaacccattgaggatcatcgctaaaagagcctcgccatgagaaaccgtatgctctgcatatttaggcaaaatagcatcaatcatgcggggtaaaccgatctcatggcaaaaagcggcgacaaggccgaggtgatcgagacgtttgatggcaggttcagagagagacatgttgggcttccggtaaatagaagtaatagatcaaaaccgaagattgccgtcaatctgatttgaggagtaaatcaacaaagcgtgcggcaaatcacatgatttttaaatcaggaatgaggtgcggaatgacggataagttaatcaatgaaattatctgcacttttgttatagtcggtaatacaatacactgacttaccgcgtccactaatgaaatcgaagatagtcctttctgagcctgaacgaatcacgttgcaacaactcgccctgaatcatcagcatcgggacatccgtacgagaggaaccggtttactcatgctggccagaggattaaaaccgcgccagatcgccgttgagacaggatgcagtgtccgggttatttataactgggttcacacttggcatgacttcgggattgccggtctattgggcggtcatgccggcggccggtatctcgccatgacgcctgaaatgatcgcaaccgcggttgaaatcgcctgttccgaatccctgacgctggcccgaatagctctgggggttgaggaaaagcacggtcctttgccatgcacgcttgaaacgctggcaaagacactgaaaaaacaggggctcacctataaacgagcccgtctgtcgttaaaaaaaacgcgatgaaacggagttcgctaaaaaatccgtcttgctggataagattaaggccggtgcacgggcaggccgctaccgtctggtctattttgatgaagccggttttgccgcctctccgccggtgcaatatggatggagtccacggggtaaaccccatgaaactgagcctcaacaccatgacagacggtcagttctgggggcgttaaattacacggacaacacgctgttttaccaggcaccgtcaggcagtatcacacgagctgatgtgattgattttttagagcaggtcgccaaacaaggggacaaccgcctgacatttttagtgttggataatgcgcgtatccatcatgggatagagaaaaaaatcagaaatcgctggttacgagaacacaacctgcttttattttatcttcctgcctacagcccagagctgaatctgattgaaatcatctggaaacaagccaaatatcactggcgacgctttatcacttggactcaggataccgtggagtatgagctaaatactctattggaaggttatggtgctaaatttgcaattaatttttcttgattacttagaatactttataaaaaaatgaaaaattcacacactatgatacttataaaaatactcttatttattatttcagtataaaagcatatgtactatattttaatcatcatggtattatattataataagttcatcgttttactattttccagcgctataggtattaatatattttaagacagcacttgttgcgatgattttattttgttccttttactagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtattctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacaccatctaagagatgaggtctttattctttagtgaaggaataaaatcattgttgatattaaattagaaaaactatttttcataatttaatttaggttctttacattattttttccataaaatggatggtgaaaatatagaaagacgttaatatagcgtgatataaataatggaaacttattcttacataagcaatggcaagttctttcgaaaacgcgatacgcctaccagtacgaatgataatgcatgagatagaatccataagaagtttacattttgacgactgaatcacacatatggctttgtttaattgtagaaaatgagcgggcagaatacttttaaggggggtataaattacatttttatatatttggttgctttatctattttgataatgcatataaattaatagacacaatgatgattttacagccatatactgatttaaatgggtttgcttaagttaattttttatttttcagttggttgaatgtttcaatttcattgtcaactttttatctgagtctttaatgaatggtttagtcagcctaaacagtgatttgtcaaactttaatatttgattaattttgtgatctggtttatctatttttggtactattaattgtaaatattatcaggagctttaaatgggtaagctatcgtgtttcccagttatggtgatggtaatagcaatgctgatatgcaatattgctgaagccaagtcaccctatgatggcgattatttgtgcaaaataaataaagaattgaacgatgtgactatcaagaatggggggatgtactttttcccgactaaccttgatacggccagagtttcctatagagatgagagttttactatttatgaaacaaggccagaagtgttcatgagtcctaaattaaccccgattacaaaatttggtatcttaaacaaaaaggaactaacggaaatgggggaaaacacattgatatatggaggagaggggcgtggtctgggctattttaggccaagtcaaaacgaatttttcatttctaagataaagattcctaatgtgaagggggcttatatcctgtctcttgaacattgtgttaagcagttgtgaattattcaaagagcagccccgaaggggcttcttcctgatctggtatcgtcacaggaatcaggatactgtgtcaaagcaagaaaagctttgtagggctaagaaaatttacatttggtagggcgctattggtttttgaatgatcctatccttcctatctgtgatgataaagtcactcgattagtgctttatggcgtcataagagaagacatgatgcatatccgctacactattccaatagtctattccattgttagtctatgctcggacaacagtgatagcttttaaacacactttggtgaagccagaagggtaagcggattgaatcatcctcacgtgctaattcctaataagctatgaaattggtatggttgaattaaaaccgggaaaacatgtattagaaacatcagatggtaagaagcaacctttcctagtttattcaaaaaatcaaggaggaattatcaatccaaacagagaattatattatacttacaatatggtgtacgctattgaaaaccatgaaaataagttttcaccacaaaatacagaagttgtcattgatggtgtgacgcttgaagggccaattcgcagtagtgacgctgtatttattgataacaatgtttttcggtgtacatatccaattggaacgccatttccagaagaaattgtaatttatgataaaaaaagtaaaggaaatattaaaagtaaatgctttagaaaaaaagagtttattgatttttatgagcaagaatcaggagaggcactacattctgaacacgattcattaaatagtaatgatacttggattcgcctaataagctaccgtcttgatggtcaagttctaatagcatagttttcatcatatgattgctgcgtatttaatactccgtagcacaaatgaactaacttacgcatcgcagcgcctaaagccaacatttttgccttccctttattaaccaatcgattatataaatcatttatgtgggggttaaaacgaactgctgtgagtgcagacataaacaacttagcacggattttagtaggccccgttttagataagcgcactcgaccatgcaccgatgtacctgactgctttgcaataggaataacaccaagatatgcagcgacttgcgttgcacgagtaaaggtattcgtacgtaagataatcagcatgttaagaccaatctgagttccaaccccctttattgaggttaaaagttcaaaatctttttttaaattagggtgctggtttatatgctcggcaataagagcctcaagctcggctaactcatttttcatgtgatgcatcattgcctctatggactcaataaccctttttggggtatgggttgagccgcttttttcatatcggttacgttcacgctggatatcttctaataacgcatcccgacggcataggagagccttcaattcgcgaatttctataggaggaggttgccagacatcgggttgttttaaggcactgtaacaggctaaaatataggcatctactttgtctgttttagtcagtatccccatacctttagcaaaatcacgcacgcgtaaagggttggctattgcaatccttcccccagcctgatgaagggaataagccaaccgttcatgatagactccggtggcttccataacgatattgacttgttgcagggcaggaatatatttagctagccacgctattaacatacaggctgaatgttcattattcagaagggattttgttttgcgtttacctttaactccatcatataacaaacaaatatccagtttattcttactgacatctattccgacataatacataataaccctcctcttatttgatgccatcacgccaatttcacttgtatatacagagtcgttgctcttggttaccgttcaatattggtgctggcgtggaaggtgaaacaaggggccttcgcttattaacaaagtctcgcttaaatgtgcaatatgaggctcaccttgtttcttatgatggtagctaaccaccataattactatgatacaagtgcaatttttcagaagggcggtcagttgctatagtaggcatctttctcgccaaaggaaaatgcactatggcctatacacaactgaccgaaatagaaagatatcagatttccagtttaaaggaagccggttttacacaacgttttattgcaacgtcgctcaatcgaaatccatcaacaattagccgggaattgaaaagaaatcaggcggtacagaaatactgccctcaacaggctcagcttaaggcgtcagaacgtcgccattctgccctaaaagcagtcaaggtgacgccagagataacaaagtggattaatcagttaatttggcaagatttaagtcccgaacaaactgtgggttatctcaagcgggaaatgagaatatctttacatcatgaaacgatttatagattgatttacaaagataaaattaatggtggtgatttatggcagcatctaaggattgctaaaaagccgtatcgtaagcgctatggaagttatgagcgcagaggaaaaatcaaaaacagagtcagtattgataagcgtccaaaaatcgttgataaaaaacagcgcattggtgattgggaaggtgatactatcgttggaaaagatcataaaagtgcattattgacattggttgaaagaaagtcgctatttaccctcattattaaacttgaaacttaactaccacctactgaagtaggtggtagttaagtaatgattaaagatatcataataaaaaaggcataagattatacttgtgattagtggctataatatcaaatattcctaactctgattttaattttaaattacgaaaatccattaaattaatatgattaccttgcttttcaggtgaatatttaaattaattttaaagatatattttatatcagttattcatcctattaaaatattacttgagtgataatctaaatcaacctttatttatttcttatgtactggatgtatctatatttagatgtgtagttatcacggtgatatctatggggaggttttttggcgttttggttgaattgcagtcaatttgagggggctggataatgccatgaaaaaatagtttataaaaaagccagctcttgcttttgaaccggctatctccatctctatactaacaaacgcttacataaagcgagttgttgacaggcggataacgacgttatgtacgtttgagaggaaagattttacagatttcatgatgatttcctttagggttataaattgtgacacacttcacgaaaatataaattctgaaggagattttatgctcaaaataaaaagagtcaaggcatttattaaaatatttttttaaaatttaaaatatttttacatttaggtgtaactcattgaaaatatttatttaattgtttttttgtattttttatgttgtcatattggtttgcttttgttctgtaattgtttttcttttggttttcacacagatagtggagtaatctcactgatttttctaagctagctatactttactcaacatttaacgagtgttttttctgaaaaatttaacttaacgatgaactcaagtagctggagataactaatggaaatcagtgaaaatggcattaataagataaaaagttatgaaggtttgagattgcacgcatatcctgatcctgccacaggtgctgaaccatggacaattgggtatgggcatacaaaaggagtgaagccagaacaaataattacagagcaacaggctgaaacatttttgcatgaagatctgataccaatttatgctgagattcaaagaattgtgaaggttcctttaacacaggggcagtttgatgctttatgctcgtttatttttaatttaggagtaggtaattttattcattcaacgttgctgaaaaagttgaatttggctgattatcaaggtgctgctgaggaatttttgaaatgggatagggcggatggacgtgtattagccgatttgcgtgttcgaagagcatctgagcagaaaatgtttatgtcataacacgatgttgataagaccttattacgaaatgcaaaaaatattaattgctggattcgactaataagtacaatttttcagaatggcggtcagttgctatagtaagggtttttaacacagctccgttctaagaatagtaaataaaatggtttattatgataatgtttaaatctgaacaataaattcgggcttatcaagcccgaataaaaaatatggattaaatatgtggtggtgtattttgtaatacgacacgatagccatcaatatcttcgaatgtttttccggttcgatcccaataaggattataagaggggacaagagaaaaaccggcttcttgcatcaattggctctgtttctgccactcagactcatcttcgatataaaaaaccaataaactatcttgtgtcggtgctttaccaacagatgtattgtggtggtgagtaaattcgagatgccaagaatgattgggatgccctaacataacaccatcaaaattatcatgatctctgaattcacctaatagagtaaattgtaatcctttgcaatacatatctttgattatagacaaattgtctgttggtctggcaatcctaaggacaggtgttgttttcatttttttatagggtttgatttaaaactgaatcttatcagttaatattttaaattgattagataaatgtgctagcgagcaactagcacatattttttatcaccttaattttattgaggaaataatattaaacctaaaatattattttatatcagcatcaatgacttgataaaaagcattatcagtatctgcaattgtccaaacaccgagaatgacatnnnnnnnnnnnnnnnnnnnnnnnnnnnnnnnnnnnnnnnnn

SEQ ID NO: 16915 - DNA, 8856 bp, Xenorhabdus bovienii
  unsure (1)..(8856): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatttaacataacgttcattgtcagaaccacctcaaaccgtttcagcgcgtttttgccctcaagacgccctttcctctggttttcgtcaacgaaaatgccttgaagcacggggaagtgtttttgaggccatgcataactatgctcgctatccaaccaacgcggcttttacgtcaaaaaaatcacgtaaccggtattttgaggacttttctcctgtgaaaatggtgaccggacctgtcattgaaacctcgcctattatgaacgccaccattgccaccattttttatctttcaaatctctcgtcggtgtcggtttatattccagtctcaacaccgtggctttcagatccgcgatctcctggcgcaaagtccgaatttccgtgagcaattcggactgatgttgtgtgccatttgactgtgtctctctgggccattccgctgtgccagatttcactagttcaccgtaaacgcggatcagctctgtggtctctatttcacgatgtccattcgcgttcgtctgccatgacaggcgaccttttgccatatcacggtataacgtccggcgacttttccccgtcaaggtttgtgactgtgtcacgctgtgccatgccataaaatacctcccgctactgacacagtatagggggttgtaagcaggaacccgccaagattttgtcactgctacgttatctgtccgtaagagggcgttgaatggacataacactgttacattcagatgggctgaaacccagcattatccgtattatttaagtggtacggtttaaatctcaatgaagctccccctaacgggtataacagctcaacgacgggaccagatgtgttttgtagcaccgctgcacgcggacggctttacaaaacgttgggtcagggcggcgccccgacaccctgccaacacctcacacgggcagattttaatctgtccgtgtgaggtgttctctgactcgtcaaccgatcaattccgcttcgttccagatagagggccagtgatagtaagagtctctaactagtcaaatttggaggttcttccattagaccaggcacaggctctctatgttttcaatagagcactttggctaaactagggataggtgtgtgttgtatggggtttaaaagaaaaaacaatgaacaagcaagagaaaagttgcctgaatattgcaaaattcattcggggacagacgctgttattgctggaaaaaatcaatgaactggatttggatgatgaagcggaggcgtgtgagaagttgcatgatgatgccgaggctctctatcatcaattagtgtcgagatacggtgaggaatgagcatgaaaagacataaattaacagattccgaagaaaaaaggctagccgaggcctttcgggagtatgccattgcgatggggttggggccgaacggtaaattgccgaaagaggtcaaacgacaaatacgagcgcggattctggggggaatactggatgatcgtcggtcggcgtcttttcctccaaaggaggaaaagacctttagctggtcagcctctgtcggcaatagaagacggtagcatactcaacacgatattcctgttctcagtcgactgaggcgtcacttgggtgttacaaaataccaagtgacgccagaaaagaacctataaccagagcttatcccgcctgaccttaaacaaaacatcacctaatgaagacagttaaatcaggtataagaatgtcgttatcatggggtttttctgggtttgcgctcgatcaaatggcctgtgctatcgaaataccggcttggccaaatttgggaagggtgcatttcaagttgattagctatgatccattctccttttggccaaggccggatcagggtattggctaatgtggatgaacttaatcctgccttacgggagattgccgctaaggtcgttccttgtttgcgtagcgcagcgatgatatcggcggggtgccagtcttgattcatattcatatctgcttcacctcgtgttatttgtggcaattcaagcagggttcgcagtaccggaagtgttcaaccggcgagtcattacctcccctgtctgaatcgccatagagaaggcgaaaacagacacacaggtaaaacaagttttacctgtgttgatgaatctcagggctgcgaccccctgctatcaattttaactgatagctttttcagattagcgaattaaattaactaattaaataagtaaaacagtaagttaaatcggtacttgattcgtattactggcgagtctcgatgacttcattcacttcataggtttccaacaatcggcttaccttgcgtatttttttcatggtggcgtagatacaactatggaggtgttgcatattctcacgtatgtcattttgtcggcagagatattctgcgcacttaattaaatcagctgcatctcgtgccagtgcataggtattttttgaggtttgataagtgaagagtttagccatgttttacctctgttttgtgaggtaagacagttgcatgtacagaggaacaccagaggattattttcatttctgctttctctattgttatggtggcgactcaaacagggttcgcagtactgggattcatcaaaccagcgagacaatagtctcccctgcctgaaccgccatagaacaggcagaaacagacacactggcaagtaaataaatctaccagtgttgatgaatcacaaggctgcgaccccttggctatcggattttgccgatagtgttttcagcttaacgggttgaataaaataattcaataataaaatcaataatatgaggttagtcgtatgagttacttatttatgtaatttccgatagagaaaattaaaagtatttaaaattacaattgttccttatggaggagtaatgcatgattttgtgctttttttaatggttaattgttatgtgattgatatggctattttttatataaagatgttatattctcattgttaattaatgataggagatgtcgtatggatgagagagacgaattgatgcagcaaataagtaatttattgatcaatagtccggtgagatcagaggataagctggctgtgatgatgatgttttgttttcaactattgtcatcaactcagacagatggggtgaatatgcgtgtttctgatagcagagtcttatcattaaaatttgaattagaaacattgaaattataaacttatatcatgattgattgtttttatgaggtgttaaatggatattaaaagacaaaatgaactattgaattttcatttgggtggtattgtgcaaatagataaggctgatggaatattaaagcctagggagagtacttctcaagcgattgaaaaaatgattcagcaattagataaaaatacagaactttatgttttattgacattagaagaagctgtcgatgctgtaaaaaatctatgtgggcctaacccaaatgcgtcatggaaagatggtttattttcatgttcagatattgtgacatcatttacgggtagtattattgatgcttatggtgcgctaaagctagcaaatgaactcagtagtaattttggtgtgaaagttaaggaatatattgataagcatggcaatagaaacataaagttaacgggtcgaacaggggttaggaattttttgacggctgcaaaatatggcgtgaataactggaaaatgatagaaatgggaataggatcgcaaggaatgcaaagtggtataattactggggctagatattgtatttttgttagtgctgcttataggtctcttgaattattgtttagggatgaatatgatgttcatagttttttcggaaatatttctatggatgtagcaaaaacagccgtaggattttttgctggcatgggggctaaggctgttgtaggaacttttttaactgctggcacctatgcccttgctgtatctgttggaatttttctagttggttttggagttgcgataatactatatcatcttgataataaatatgaaataagcaaaaaactgataaattttatgcgagaggatgcgataaggtatgccgaaaggaatagagtaaattacggacctcatcctgataaagttttcagcgagttagggagagcttggcgtggataataaaaatagggttgtggttataataagctcattgtttattttattccttatgtctcttgctgttttttttgtctgtgaggactttatatcaattattaatatgggagatgaaattatattttcttggaagctgtttttgtttttcttttcttctcctttgattttttatttttgtatttgtgctatttattataatgctatttcaaaaccagcgaaacttaataacttcactgtaaagattctacttgtaaatttttttgtttttttgtttttgagttttcctttttcttggtacttggattctaaactgaaggtggctggatatattatttgtgataaaacatcatttaactcacctaataaatatgtaaaaaatccaagttcatgtcactaagcatatatctaatatatgcttagtttttttataagactctgtcttcccatatgctataggctgatgtgcctgctgttatatgattccatgttatggatttataatttagaacaactttctcatatggcattttatcgtgttcatttatagagtgtgggtagacacaggaaagatcagtgatagttgcctctgtgattttgacttcataaaaaagttctagttgtcctatttggcttgttctatagaaaataaatgcgccattcagtgattcgttggaatctatagccattgctaataatggggaggatttgtctatgggtttgacgaattgtactggattatgacttacgttctgttgacgcattagcgagtgatttaaactcaatacctgtattttgtcttcgtgccccttttggtatcggtttcctatcgaatcgagagtagaacaccctgctgatattaagccttgcttcttaccatttaacgataaataaatcatatatgacataagtattactatcctatttttttattgaaatcatgttggcgtagtggtctaagcctgagagaaacaacttaacacattaaaaaaacttgtgatgggatcgtcaaggcaannnnnnnnnnnnnnnnnnnnnnnnngttaggttgtaatctttagtcttgaaaagaaaaaaccatcccggcaaggatggttttctcaagattgaacagtccgttaaaactgtccaatcgtggtaacaggcttgagtaagaagctgtcaccgaaaatgtccttctagtgtagccttaaaaggtgaaccacttcaagcactctttcaagcacatctgacacctcttctcgttcatgtctgttaccaatggctgctgccagtggcgttaaatcgtgtctgtcggggttgggatcatgcgactaattacccgacaagacgcagcagtcggactgaatggggggtccgtgcatacagcccagcttggagcgaactgcctaaccggaactgaatgtcaggcgtggaatgagagaacgcggccataacagcggaatgacatcagtaaaccgtatggtgggaacaggagagcgcacgggggagccgaccactggaaacggtggtcatctttaagtcctgtcaggtttcgtcacctctgacttgagcgtccattttttttggatactcgtcaggggggcggagcctatggaaaaacacgatgcggctgacttgtctcggactttcttttcttgctttagcccgcaatgctcgccgcagtattgactagcgtagtctgttaatatgttatactgtcattttacatttaatggagattgttatgggaattaaaccaggacctaaacctattgctgaatcaacaggaaaggaagataaacgacagagagtgacaccggaaaataagcctaaacatccggatttgaaagagcatcaacacaaaaagggtgaataagaggttcgtttcagaattttatctggagaacgtctctctgatacgcgaaagaataatcagacgggaatattgccaaatttcttaacagaggctttgatttcatcaatccactgaatagaacaagagtaaacttggttattgatactatagtgtatttgccgaaacacctcttgttagtcaatgaactaacttcacatgtgcaatccagcaggatttcatcgttctcccagttcgcgtctttacgtagtctgcaatctgtttatatgttgacatttccaatttcctgatactcactatttactataacgtctgaacaacgaagcctcctcgacttcttgaaaaaaaaacaaatgactatatttaagtaatgggtaatattcgcccattacttaatattataagggagtaggatggcgttctatgaaaacaaaaagtctgttcttgaaacagataaaccagaacagtatcggaaaatacgtagtatcggtgagatccctccaggtccaggaatttatgaatgccagacctgtaagtacgaagatgtcgtgaaccgtgaatgcgagaagcttccaccttgctctaactgcaagaaaaagggccacaccaataagtggaagcttctcgtaaaagctacagataaatagctatcctcaaagccctacggggcttttaaggcataacatttgctgtcggaacctcctgaacactactttgcgagtttttgtcttcaagccattttttcctcatgtggttttcgtcaacgaaaatggcctgaagcacggaaacatgcttttttaggtcatggatattaacctcgaatatcccatgtcagagtctaatttcttacgtagcgcattctttacggcaacagaattgttgaatccttctgtcacaacggcttaatgcgccgccagttcctgaaagaattttgggttttcctgaatggtcgccagtacctttgctgccagtccagtaggattacgtcttccggtctcccagcttttgatggtgtcgatacttgttcccagaacctgtgccatttcactctgtgaaacgttaagttgtgctctgatggacttcacatctgccagttcataacgtgtgacacgttcgggtgctttaacaccatttttgatgtcgacagcttcttccagtgacgcttttaggtcgtcaaaaaaactcatgttacacctcgtctttcagtaattttgtcagctttttcagttctgatttttcagcatccgtcagactgtctttggtgcttttcgggtaggccattaccaaatagataatctcttcggtggccagaaagtaaatcaccctggcactgccgcttttcccttgtgagcctgtcgccatcctgatttttcgcaagccacccgttttctggattaaggcccctttacccggaaattcaatcagctctttctggagagctttgagttcatcgtccgtggcaatttgctttatctgccgggtaaataacggggtttcgataaactctatagcatgactcactggctcattctcctctttctttaatgtacatagtacaccaaagaagatcattttccagcagcagtcataaactcatgccatgatctctactacgtcattttcagtgataaccccgcaaaaagcgatgtcggtattggctggcttcattgggttagattttgtctaacatcaggcaggatatatcattgacggttatttttgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16916 - DNA, 1155 bp, Xenorhabdus bovienii
  unsure (1)..(1155): unsure at all n locations
nnnnnnnnnnnnnnnnnnnnnnnnnnnnnnnnnnnnnnnnnnnnnnnnnnggccaaaccgttgacaacgtcaacataccaacccgagaacttgggacccgaccgtgcgcccgggctacggccggctcgcatgagggaacgaccagaccagccgaagcattacgcgaggcattaagacctcggaggagtcaaaccactcctccgaggcctcgggagctacacccggcgggtgcgctcgcgcgcacccaccagaacaaaacgcaaccgagaaaggctggtcccctagcaaaaaagtgcgacaaaagcctccaagcgagtattaacactcccttcgaggctcgggggctactttcggggaccataattaggggtaccctcaagactcctaattctcagctggtaacccccatcagcacaaagctgcaaaggcctgatgggtgcgactaagtcagggatcgggccattcgagggactcgatcacgcctcgcccgagcccagcctcgggcaagggcagccgaccccagaggatcaccgtctcggccgaggcccccctacagcgacgaacatacttccgggtcgccagagggcctggcttcgtcaagaagccacccgtgaccaaaatcgtccggccaaccgaccaaattggaggagcatttaatgccaagggggggccgacaccataatccggacgcacgccctccagtcgaacaagccgaagcgacccgagagacttctgcgcccgaatgacccgcgctgacagaagggaaagggccgcctgccccgttccccctgctgggccactcgacaaagtgggggctgacaggcacgtcaggcctcggcctcaagcacccctagaaaactccgtttcgcccgccccaaggctctgagcccgggcttaagcccggaagagggggactctcttctcaccggccccggggtggaagtccgcgtagggcctggaagaggggaaattcgggccacgcgaaccaggcgagtatctcgggtaaggccttgaagactgtgattggatacggccagcccacggtggggctcggcgtaatacgagtagtagcacatgcatgcgcgcagggacggggatgaccgctgtgggcgcgaagcgtgcacgtgcccgcgcgacgtaggggcgtctgggcgc

SEQ ID NO: 16917 - DNA, 3277 bp, Xenorhabdus bovienii
  unsure (1)..(3277): unsure at all n locations
nnnnnnnnnnnnnnnnnnnnnnnnnnnnnnnnnnnnnnnccatcagcacaaagctgcaaaggcctgatgggtgcgactaagttagggatcggtccattcgagggactcgatcacgcctcgcccgagcccagcctcgggcaagggcagccgaccccggaggatctccgtctctcccgaggcccccctccagcgacgaacatacttccggctcacccaaggcctagtcttcgccaagaagcaaccctggccaaatcgccacgccaaccgaccaaatcgcaggggcatttaatgcaaaggtggcctgacacctttatcctgacgcacgtcctccagtcgacagagccgaagtgaccgcagtcacttcgccgctccactgaccggcctgacagaaggacagcgccgcctgcgccgctccgactgctgtgccactcgacagagtgaggctgacaggcagtcaggaccgacctcaggcaccataggaaactccgcttcgcccgacccagggctcgggctcggccccggaagacggcgaactccgctccgcccgacccagggctcggactcgggctcagtcccggaagacggcgaactccgctccgcccgacccagggctcggactcgggctcagccccagaagacggcgaactccgctccgcccgacccagggctcggactcgggctcagccccggaagacgacgaactccgctccgcccgacccagggatcggactcgggctcagccccggaagacgacgaactctgtttcgcccgaccccagggctcggactcagccctggcctcagccgacggtctccgcctcgcccgacccaagggctcggactcgacctcggcctcggaagacagactcgacctcgacctcggaggagcctccacatcgcccaacctagggcacggaccgaccacgtcaacaggaggcgccatcattaccctaccccaagctgactcaggctacgggaaacaagaccggcgttccatctggctcgctccgccagacaagcaatgatggcgccccgcacgctctatgacgacgatggctctcagcccccttacggaagcaagaggacgtcagcaaggactcgacagctccgacagctgtccttccgccaggctccagcgctcctccgacggccacgacaccacacgaaccgggtgccaaaacctctccggctgccacgatggcatgtacttagggcgctagctctcctccgctagacacgttagcactctgctacacccccattgtacacctagatcctctccttacgcctataaaaggaaggaccagggccctcttacagagggtgggccgcgcggggaagaggacgagacaggcgctcgcgtgaggccgctcgctcccctcccgcgtggacgcttgtaaccccctactgcaagcgcacccgacctgggcgcgggacaaacacgaaggccgcgggatttccacctccctctctccggctgccttttccccccttcgcgctccatctcgcgccgacccatctgggctggggcacgcggcgacatttcactcgtcggtccagggaccccccggtctcgaaacgccgacaattattacttattaaatttctctttggtctataaaatatttgaataaatcaattctttgagttgtcttaaatcaaactttttaagtttcatcgaatttactaaaaaacaccatgacttatgatattaaattaataccattagatatattgcaaactatattataatatactcatttggttcataaatatttatgttttcttaatatatttactagtcagttgttagtgctttgctatagtttttatatatcatataaattgaaattgaaatatttattcgaatataattattgtttatttataaatatttaggtacgtgtgttttgttggttagccccaaatttctggagcaagggatgtggggttaagtgttcactttgcactattttttatataattattgtttatttttaaatactatggtgcatgtggtctagtggtagttgcgcgggcgggatcaggtgcgggatcaggtgtttttttcgagtcgtgatgatacaacttttaccgtttttatataatatgatatacatctagcgtataatttattaagttataggcttttgtcgtcttcaaatgaatgaataagaggaaaacaaaagttataattactctaaataatatgaatgatgaagaagagttgtttgtgtattttattatcttaaaaattaggtaatacgtcactttattatgtatatgtggaaactataaattatttattattctgactagagattatcgttttcgactgttttcgaataacagacaatttcgatctcatattccgactgttgttttttttttcgtttttgttccgatcaaaaatatataaaacaaaacataatctagttttttcgatcgtttttatcaccagttaacgtgtttgatgtagatgtcgtttttggaagtgtcgtgagttcaagttgctcaaaggatcaagcttttgtcgtggccggagcaaggacatggccctgggccaatgggctctgagagcgatggtcctacgtcctagtagctgaggccctataaaaatatatatgtcgagatgtttgaacgcgctttagcagcgatcagcaatcaggtaaactgtttgtttgactttaatttatatcgtttttactatttacatagtgttgtgtttttatatatcacagctgcaagtaggagtggtaatgaattataatccaaatacttcttcgtaaaatgttaggaccctaaataaaatttagttaaaaatgaatagaaatatgactcgattctaagccgattcgattcttaaatcttagtgtaaaatttggagcttattgttagctctagttgcaggagtccgaacaaccggaagcaccaacatgtagaagcattactatttcgtggacaccattaaacttatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16918 - DNA, 128857 bp, Xenorhabdus bovienii
  unsure (1)..(128857): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggaagcatattccccgaaggatctctccaagatgctgtagatgcttgtttagttgatgcaactttatgtaattttatagtagaatttagtcctctttcagtacttaaagatgttaaagatgcagaaacaggaacagattatataattgcagcggcatcagcagccccttgggcaaaattaggaaaagcagctgataaaagcgttgaagctataaaaactcttgctaaaaatggtaagtttgctgaagctactaggatttacaatgattctcttagaagtatgggtaaattctttaaagggaatcatagagttaatgatttaagtaagcttaaagatatgaatttagagcctaatatgcttagagcggggactaaaaaatatcttaaaagtgaattccaaaaacctgatgcagctgttagttatgctgcagcatcagtaacagttaatggtaaaaaagaatattacttatctgtaaatggtgcagcttggtcaggcaattctcccaatgtcgtaaatattaagggggttaattttaatgtgattagaaaagatcgtggttctataccatcagctcctaatggaaagcaaactaactttaatcacgctgaacaaaaattatttagtcattttcaagataattttcaaggtaagagagtagatataaatatgtctattcagaatactagtgctacatctccaggaatgtgtgctggctgtaaacctaatagcaaagtatttgtagatcaaaacaaagattttattattaatatatttgagggtacaaccggtagaaaaccctaaatatctagtgataaattcaatataaagaccttaaatcaacatgaagaccttaaatagagaaactgtatctggagttagtttttatactatcagaatgacatatgaagaattaattattcttagggattgtttacatgatattttgcttaaatctgaagagattgaagaaaaaaacctagataaattgtcctggtatagatctgcttttttagaaatatcagattatatacaatccaatatttcacataaaacaaatataattttgaaaaaagaacatttaaacaatgaaatattctataaccttagattctcctatggagaacttaagttaattatatacactgttatgaatttggaggaagatatcaattataaacctttttatagaaagttctctttcagtaaaaaatgtaatgccaagttattgaatgattattttcataaattacaatctttatggtcagtagattaattggagttataaatgactaaaacagaattaatagaatatctacattctgcttacccagagttgactatagatattacttacattaagggctattcagaagaagatatagtaaaattagaacgtttatatgatattaaaattcaaggtcaattacttgattttttaattcacatggggcgttgcagtggaggttttttttcaaatcaacctttaagtttttatagtgaaactgctaatatcagagatgagataaaatttcaaataggatgtgaagatggattaagagaagttcaacgatttgatttagtagaacaaaaacctttctttatttcaatggaaaatgaaggaattttgcattatttcttattaactgattcagataatcctgatttagtttattatcttgatactaactatgacacaatagtagatactggtttaacttttaatgaatatttaagaagcgttgtagattctagtagaggttatgcttgtaaaatcccacttgattatacaggagacttacttagaatataacaattaaacctatttcattattattagatctgctttgatttaaatcaaagcagatctacctaaaaagaggcttttatgaaaaactttaaaacttttacaaagatttctacattaactttgttagtttctactaacctagcttttgctaatgatatcattcctaatgattttaacactcaagttaaccaagttaataatataccagttatcaacatagctactccaactcttaacggtatgtccagaaatacctataaagagttcaatgttagtgaaaagggcgtgattttcaataattttatagattctgttaattctcaattagcaggtcaattagagaaaaatcataatcttaaggataggactgctggcttaatcattaatgaagtagttggcggtaatcaatctcaacttaaaggagctatagaaatagttggggaagatgctaaattagtaataactaatccaaacggtgtctttattgatggagctaaattcataaatataagagagtcttttattagtactggtaaacctgttttcaataaaaaagatttacttagtttagaagtaactaaaggtaaagttactattggagaaaaaggcttagattctgataaccttgttgttttcagtagatctcttcaagtaaatggaaaaattaatgcttatactattacagcgatgataggacctaattccatgagtatgaaggcaggggttacgcatgaaattttagtaggctaaaattgattaaataacagcgcttccatatagccattatcccacccggccgatttccttcgggcacttaaactcagtttactgttggtatctcgtttaacgatattgagtgccattttacgtaattgggcaaatactcttgtggcgatccgctctctcatccgtgagtcatcttctcgaaaagtgacatccagtacccaatgtaaactattctctatagcccaatgttttcttatggcacctagttgaaaggtgggagaatcatggcaactacttaaataaggggtccgcttggaaaacggaaaatatcccacgctaagactgttttttaaacaggccggggttagcaggcagctttgagcgaggtgcggaccttcgtgtcgcccctcgtaccaaaaaatgaaggtgctaacttattaagcttcagatggtcatttattgattgtcgaaaatatctcttgcggcaaaaataccatttaactctgctgggaaacctgcataaatagccatctgcttaatagcctcaataatctcaacttcagtgtgccactacaaccggctttattcagaacgagtttcattttttgatttctcaataaggctcttaatctgtctaatcttttctcggatacctttgtcctggctgtacttctcgagctgatcaaatctgtaaaaactatgtatgttcagctctggagagttattgtccttcacctgtaataaggcttcggggtaatcaactctcttatttttatatataaagaaacggcgatagctcgatatgtcgaaattttcatcttcatcagagttgtctgcggagcttctactgaacaatgaaaagtttcgatagaaatccatattcatttcaaagtcactcgccttattcaaaatgaatttttgcgcacagtaatcgacaaaatttttaatgtcagattcgaaatctgccttgttcttctgtttttccgtctcctccctgattatatcaatttctatctcatgtaatgatttggtgttttgtttatctttctgtttatcatacgccgattggatgcgttcatccgtaatccctagaccacctaagattatatttcgttctttgtaatgccttctgtctggcgtgaaaacatactcatttgctttttcgattcgttgataatggtatttataaacaggctcaccttcataactattatttaacaaaatgtagaactgaaatgttgaaaacagctctacataacaacataataatgagggtttttcttttgatgtgaaaaggattaaagtgtgtgaagggtagttggctaaatctgctttttctttttcaattatcctatcaatgatgctcaaaggagcatattgaattaacacgactttgtcatctatcagtccgccattttcgtttgaaatttttaacgccaagggtaacttttctctggagatcccgtgggtgcaggcgaagccaatggcaattttcgcgatccctcttttaaaggcggtgttctccatgggaaactggtactgtacgttaccgtcaatgtcgtcacacatgacgatttctggaggtgtgtccaatcccatattttcaatttctttctctacgattttcttgtgattttcaaactgtttttctgaagaataaacaatcactttcttcttatcctcagtaaacctgtgaaagggtttaacgggggtgactttgaaattcttccagaaaactggggtgtctttaaggttcatatcataagcatccttttcgcttacgatcacaccgggaatggacgggcttttatttgcctttctgtctgtttttatatcaagccgtgttgctattccctcaaatattgcattaaaaggagtatctatttcccggctgaggtcgccaccacatcctttacaaaggatgcccttacttatcaaattcccacctatagcctgttgtatgacatgctctccatggtccactatggaactttgattgaatttatttccgcaaaaataacataagtccatgattcatccttaaggtaaattttaattttttcttggtttgcgaaattatatacagtaaaaatatttaaagtatatggttctttgataagggtttctggcaacttaatgctgaacggcatcctgcttatttaagcgttaaccgaacgatcgtgatttaacagcagcttgaacaacaagcttgatggacgtattaccgtgcacgtgcataagcggctacatgtccctgacttgctccccgttgattaacatagacttatgttaatagcgtccgtttctggcacagactgtgtaaaaacccttgatcaccttttggtctaagtacgatgtacttatgatcaatgggtcttagctaccgatccaatttcaaagccaagtccagtatcatcagattggtaagcataatcatggagattctggcatgtctcaccatattactggtcaatcaaggcatcaatccacgctctttccagaactcatggacgactttgttagcgaagataacccagtgcgagttattgatgtctttgttgaacatctcgatttactcgacttaggttttgaaagcgtgaatcccaagtcaactggccgtcctagatatcaccctgccacgatgctcaagctctacatttacggttatttaaatcgaattcaatcatcgcgacggctggagaaggaatgcaaccgcaatgtcgagttaatgtggctgcttgaacgtttatctcccgacttcaaaacgattgcaaacttcagaaaggataatggtaagggaattaaaaacgtttgccgtcaattcgtcgagttatgccgacaactcaacatgtttgaagatgccgtgttcgctattgatggtagtaaattcaaagccgtcaataataaatccaaaaattacacccccagtaaagtgcagtttcatatcgagcgagttgaaaaaagtatcgagaaatatttaagccagatggatgccaaagatgagaacgaaaaagagtctgatctgattgtcgcagcatcgaaattagcctggctaaaacagcgcttagttgagctaaaagcactcgaaaaacaagttaatgagcatccggacaaacagatatcacagacggatcctgatgcccgcttgatgaaaacacaccacatggaaagacaagtctgctacaacgtgcaaacggcggtcgatacaaagcaccatctcatcgtttgccacgacatcgtcatgacaacagaccgaggtcaactgacattagttgccgggcaagtccaaaaggttttggggaaggaatcgattaccgtgttagccgacaaaggctacttcagtcgaaatgatatcaaagacgcggatgatcaaggcatcacggcgaatgtgccacaaattgacacgtcaggttcggagagcaaaggcatttttaacaagtctctcttcaagtacgacaacgacagtgatgtatacatttgtccggcgggtcaaagtttacaaaagcgaatgagagtagtggagaaaggtgtagaactggatgtttactttaacaatttagcgtgcaataaatgtccaatccgatctcaatgcacaaaatcaaagaaagagccccgtcgcataagacgatggatacatgaatcgattattgatgacatgcaaaaacggttggacgagcatccggaattcccggtgataaggaaacagagtgttgagcatccgtttggcacgataaaaatgtggatgggagcgactcactttttgactaaacgcctcaaaaatgtgagcactgaaatcagcctcagtgttcttgcttacaacctgaaacgtatgatgaccatactgggaactgtcggtttgatggcagccatcagtctgagctgagtgataaagtcagcttagtttcaccaaaaatctgccccaaacgctcaaggcacactgcttttaaatgacttcatattacaagccaccaatctgcatcagaacattgtgaatgtgatgagcgctaatcggatgcttaaatgcaacccaaatcgatgtttgttggatgaaatcacggtttttacacagtctgggcacatagcaaacagtcaagccaagaagctttaaaactgtatttacattcagggttattgctgtcctgcctttacccggagtatggtttgtcgggtggtattaaattcccgggcaatggcgctgatactgatcccggcattaaggcgttctgtaactatctgtctttgttcctcgctcaggacgggcggacgaccaaaacgtttacctgaagccctggctcgggcaataccggcgtgggtacgctcaagcaacaggtcccgttcaaactccgcgacagcagaaatcacctgcatggtcatttttccggccggactggtgaggtcaacaccgcccagcgccagacagtgaacccgaatatctgacgtcgctagttgctccacagtctttcgcacatccattgcatcgcgacccaggcgatccagtttggtgacaatcagcacatcgccattttccatgcggtcaagcagtctggcaaaaccggggcgttcgctggctgccaccgaaccgctgatttgctcctcaatcagtctctggggtctgacggtaaaaccggcggcttcaatttctctgcgttgattttcagtagtctgttccagtgtcgataccctgcagtaggcaaaaactcgtgacataacgttactttgtgtacgaaaaaggtgtactaattatagcttacgtacgaaataaaaaacactcactttcgtacagtgtcgctgcaggttgtccgaaaccgaccgttttagtacatgatatttgggcatacataaatgtcacattccgtttgttaattttcgaaagttggattcatatttgaatctaattttgattcatatatagtgttgattattttttattagcatgcactattgtatatcgataaaattaatcaataggataataaatgaatgaatcttttttgagtcacttaaaggaagtatatcaagatcgtgaacgagatctcgttacattaagtgtgcgtgtcagtgttgaggagaatgcggccattcaggatttggtagattcagttggctgtaaccggcaggatcttctttatgaactaataaaaaaatacgcactcagtgaatgggaggtgatgagaaacgaagaactggatgccgaactcagtggcggaggtgcatctggtgataaccatacgaagacctattttctgcttaacacaaacaaagccaatagtgctaaggatcaccaatttatgattgaaaatggctttgctgctgcatttgaagaaggttatatccagaaaatagaaaaaatccatgaaggagatactgtctttttgtatgagtcaggcgtaggtattgttgcttacggctcagcaacgggtaaggtactgaaaacagatcatctcggtgtaaaagataaaacctattatcaaaaactggatgggtttcatgttctggataaaccactgcctgccaaaaaaatctgtactctgcttaagaggagaattcctttcgtacaaacacttatcaggcttaaagatggcgaaaagcttctgaaataacggcttgattgcaggtcatgtattgaatagttagttaatgtgatattttatggtgaagtatggctaaagttgacattgattgtcgttattatctcaaatcagaaaaagtgaaaggacatggaaaaggtaatgggggacatcctcgttatcgctgctatgactgttgcaaagtctttcagttggaatatacctaccaagcctgtaaactgggcgttaaagagcaaattgtcgatatggcaatgaataatggcggcatccgtgataccgcacgtgtactgaaagttgccacctctactgtcctgaaaacactaaaaaacttagcccccggaacgtgactacgctgccccttgatggaaataacattcagcttatctgtgaaatagatgaacaagggtcgtttgtaggcagcaataagaatcagcgctggctttggtatgcttgggaaccccgaatgaaacgaatagtcgcacatgtttttggtgatcgcagcaggaagacactggataaactactggcattactgtctccttttaaagttcgattttattgcacggatgattatgcggtttatgattgtctttcagaagaagagcacttaacaggaaaaatgtttacccaacgaatagaaaggaccaatctcacccatcgtactcgcctaaaaaggctgaatcgaaagacgattggctattccaaatccgaagagatgcatgacaaggtgatagggacgtttattgagtgtgaaaactacgtttaatgaacgatctaactattcaatacatgaccaaaaaagcggccacaagacatttatcactgataaaacataaaattaaaacaatgacctttgataacggcctcgaatttgccgaacacaaacttatcagtaaaaatttattttgctcacccgtattccccctgggaaagagggataaatgagaacacgaatggattaatcagagattacttcccaaaaggaactgattttaataaggtatcagagctggagattaaccttgtggcaaaccgattaaataatcgccctcgtaaaacacgagattacaaaacaccgaatgagttatttaaaggaatacccactcatttacttcgttcattacggtattgcgcttaatatgtgaatccaaggtggttagcttattaggcgaatccaatatttatgacgtatttttcataatgtagagtctctattttttcattattaagggaaacatcatggaaagaacattttataacaattcagaagtacctatgaccataacgcttgaaggaagccacccagtaactccaagcgttctgaaattaattaatcctaaagaaatagtaactttatctgttaaagaaaactatataatgcaacttaatttatctataaacctgccggaaattaactttgatatggttttcacatctaaataaaatttcaaaataatagatcacttgaagggaactcagtccgattttcgcgatctgattaatcgccaaatcaaaacaaatcactaaccggactgagttatgccgatcatagcacccatatcccgaaatgaacgtcgccagatgaaaaaaattatccaaacaacccgagataaaaattatgcacgcagactgatggccctgttgatgctccatcaggggatgtccgtctcttatgtcgccagaaccctttgtgcagcgcgctcttcggtcaatcgttggataaactggttgacgttctatggattagaagggctcaaaagcctgcccgctggcagacccgcaacatggaatttaacgtcactgttccctttgctgtcttttttggtccaacattcaccacaacaatttggctacctgcgttctcgctggagtttggagctttttatcattcaaatcaaagaactgataaaagtgaaattctcgaaaagccccttttatcgttatttatgccaggcgggtatcgtttggaggagagccgctcccaccttgaaattacctgaccccgagtacgatgagaaaatggcaaaaatcacggaagccttgtccaattcctcagagccccattcggttttttatgaagatgaagtcgatattcactttaatccgaaaatcggttcaggctggtatttcaagggacaacagaaacggatcgctacacccgggaaaaaccaaaaacattatcttgcgggttgtctaaacgccctgacagggaaaatcacttatgtcggaggcttaaataaaaactctgaattatttatcaatctgttagatgagataaaccgccaatatagctctgcagaaacaatcaccctaatcctagataattatggcattcataaaagccggaaagtcatggattggctggccagaaattctaaatttaatctcttatttttacccgcctactcaccttggctgaataaaattgaacgcctatggcaatctctacatgaaacggtaacgcggaaccattgctgtcagtttatgtggcagttgattcagtgtgtgcaagttttcatggaatcagcctcattgcagcaacagcagaaaatgaaaaaagggggtgtatcactattatgaaactttatttaggggggaagagtcggaaataactagtcttttaagaaacgaaaaattcagtcttaattataataaaataaataaatttaacccaccaacaatgcctgaatattttcagatttctataattccgataatttagtcgcaatataatatagcttaacgtaactaacaggaatttatgaaatgaataacattacttatgataagtacatatataaccaaactgaattcaatttttacatatctatattcattaacttaagtagacagaaaccattcgtaacaaaatatgtagaatcttttcactggtggaaatttgagtttccatatattcctataacatctggcataatttttcacagtgtgaaaaatacattacaattgaaatattttttatcagatccaagctcaacagggatttatcctcttcttcaaaaacaaaccatttatttacatcaaggaacagaagacgttagattttatttttatttagaagggtttgatggaatagtacaataatagtgcaacaggcaatggattgaaaggtgggtcaactgtcggtacattttgaagttctcacacagccaaataattgtctgaaatgaagtctcaaaacaaacactaccaacagttgacccgcgaacaaagataccagctcgaggtgctttatcgcaaaagacattggggttcatcgcagggttctgtctcattaacagagaaagtctgagtcaatgtggggttacgcagtcaatcgataaaacctctctgccggtgacaatcctttctcttctggttgtaagtattgccctttacgtggttatgtattaaatagttagatcgtttattaaaaatagttctcacgctcaatgaaagtaccaatcactttatcgtgcatttccgccgatttagaataccctatcgtttttcgattcagtctttttatccgggttcgatgcgttaaattatttctttctaaacgttgggtgaatgtcttcccagtcaggtgttcttcctctgggaggcggtcatacacagcataatcatccgtacagtaaaaccgaatattaaagggcgataaaagggcaagcagtttgtctcatgttttccggctacgatccccaaaaacatgcgccactatccgtttcaggcgaggttcccagacataccagagcccgcgttgatttttcttgttccccacaaacgacccttgctcatccatttcacagatgagctgaatgttatctccgtcaaggggaagcgtcgtcacgtttcgggggtaagtttttagcgttgtcatgacggtacttgtggccactttcaggacacgggcggtgtcgcggatcccgccgttattcattgccatattgataatctgctctttaacaccgggtttgcaggcttgataggtgtattccaactgaaagaccttacagcaggcataacagcgataacggggatggtcaccatttcattttccatgccctttgacatgttctgatgtgtgacaataacgacaataaacgttaactttagccatgatccacccttaaaaagtgagagcatatcacaataactaactatttaatacatgaccacccgtacagcaggcgccagagatactgttcgatatactgaggatgaatggctgctgcaaaatctgtcttactggctcatggtcaaaattgctcctgtcacccagccatccggtactacactatgcaacgattttaaaagcaaaccgaacatacaagttgctccagtattcggatacggaatgcatctcaatccaggcactatgatgccgtaaacctgaggggagccactcctttacgtctctgacttctcgccgcaggtcaaatattggtgggaagtgctcacctaatacgacagaacccaaaaacttcagacaagcccagaccgtgttggcagggattgaattgatctgtatgttgtgcaaaggacaataccgacaaaaagaagggtgtccgatttcaccagcggcatttttctatcaattagctgagtaaaaatcaatcacctcatcttcactcgtactttctttgttaataaataacacgctccaaggcgggacgtatcgacttagaggcgtagacagtattgaataagcgcctgcctaatactttgtttggtacttagaaacagtaatggataaacgacaccttctgactcagaaaaacggtaaatagctcttaactggagtttggggtcaacatagtcgtgataagtagtgaaaccaagatctgctgcctccatacatactggagtgctttcaggatagtcgtttacccttccctcaaatccaacaatgaaactatcgagaaactcttgggcagtgacctgacctatatgtcttgccaaatagtagaaccggccatgaagttggtcccggaacgcaaaagaatattcaaatttcatcaaccaatcctttcagtccggccctaaggtcggcagatgaaaccgttcggcctgcttgcacgtccttttcagcaaaagatagcagccgtaacagggccatctgctcttgctgcatttcaaactgaacaggatcttgaaccacgtagagaggttctccattttgtgtgacgactacgggatcagaaacatccatagaagccagttctttcttgaatgctgagactgtagttatgcgtggcgaagtagatagggtcatgggattctccaataatgaaatacaactactaatgaaagaatatacccaaatcaccgatgagtccatatacggcccatatatggacatgatttgctttcatatgtgaaagggttctgtcgcattaagcgatcatcaggtaagctcccctgtttttgagcgagtccagagcaatgtcccttatccgaaaagcgttcaaacgtctgcattaccctgttgatatcatcgctcagtgtgttcgttggtacctggcctacatcctgagcctgcgtaatctggaagaaatgagggcggagcgggggattgccgttgatcattccacgctctctcgctgggctcaccgcctgatcccgctgattgttaaaggctagtggtgtagcaaacccgctgttggacgtcggtggcgaatggatgaaacctatatcaaaatcaaaggccaatggaaatatttgtatcgagctgtggactcagacggcaagacagtggattttttgttgacggctcgtcgggataagtcgtcggccttgcgtttcttcaaaaaggcgatgcgtcagcatggccaaccggacgtggtgacaatggataaaagtggcgccaataaagccgccgtggatgaattaaatcaaggaaagccaaaagaggaagccattgttatccggcaaaacaaatacctcaataatttgattgaacaggatcaccgcaacatcaaacggcgaatacatcccatgctgggatttaaacatttccggcgagctcaaacgttattgagcggtattgaattggtcagtatgtaaaggacaatatccgcaagaaccagagtgttttctttcacccgccgactttttctatcaattggctgcataaaaaataattacatcattttctcttgctagcgctctgttaatgcgacagaaccctttagttcccttcttaagcaaatctcaggttaagttaaaaagtggcaaaagaattgaaagtataagctgtaacttatataatggaagtataagccataccttatgaggatttgattttgtggacagtgatttttaccccaaggtttgacgcctggctacaggagcaagaagaagggatgcaggaaaaggtactggccgatctaaccaaccttgaaacgtatgggccgaaactatcgcgtccttacgccgatacagtgaaaggttccaggcacaaaaacatgaaagaacttcgcgtacagtattcaggccacccggtacgcgcgttctttgcttttgaccctaaacgtcaggctatcgtgttatgtgccggtgacaaaagtaacaataagcggttttacgacacgatgatccgcatagcggatgaagaatttaccgcacatttaaccgtgatcgaggagcagaaatgaaaacattacgtgatgctgtagcagcccgttcgccagagagccaggcacggattaaagaaatggcggatgaaatgattctggaaactggattacagctgatgcgagaagaattgcagttttcgcaaaaatccctggctgaatccatgggagtcagccagcctgcgataactcaaattgagcaacgaggcaatgatgttaagttggcaacgcttaaacgttatattgaggcaatgggcggaaaactgagtctgaccgttgaattaccagaaggagggggacggatatttcatatctgaccagccataaaatttaaggagcacagatgctgattaaaatgggcagtgtcgcgttaacggcgacaagttagcaaaagtggtgttgccgattattggttctgtcgcattagcagagaaagtgcatcaaaagatgaatacgattattttttatgcagcgagttgatagaaaaattcggcgggtgaaagcggacattccggttcttgcggatattgtcctttacgtaacatattaaccagctcaatgcccgctaatacgctctgcgttcgcctgaaatttttaaatcccagcatgggacatatccgccgtttgatattgcgatgatcctgttcaatcaaattattgaggtatttgttctgccggataacaatggcttcttcctttgatgttcccttgttccattcatccacggcggctttattggcaccgcttttatccatcgtgacgatctcaggctgaccatgttgacgcattgcttttttaaagaagcgcagggcggccgccttatccctctgagctgttaacaaaaaatccaccgtattcccgttcgaatcgatagcccggtagagataacgccattgtcctttgattttgatatcggtttcatcccttcgccaccggtgacccacgtcaggcattttccgacgataacgtctgacaatcaagggggtcagacggtgaacccaacgggaaagggtcgaatggtcaacatgaattccccgttccgccctcatttcttccaaattacgcaaactcagggcgtaggctagataccaacgcacgcacgggggtgatatcaacaggatagtgtaaacgtttgaaggcttttcggataaggggcatcgttagaactctcaacaaaaaatgacaggttacctgactcccaggggttacgcatgaaattttagtcggctaaaattgattaaataacagtgcttccatataaccgttatcccatcccgctgattttcttcgcgcactcaaactcaatttactattgatatctcgtttaacaatattgagtgccattttacgtaattgggcaaatattcttgtggcgacccgctctctcatccgtgaatcatcttctcggaaagtgacatccagtacccagtgtaaactattttcgatagcccaatgttttcgtattgcacctaactgaaaggcgggagaatcatgacaactgcttaaataataacgaaagtcagaagtcaccgtgtcagaatagtgttcttgtcgtatcgtttctgttaccaggagagcttgaatatctggccaagaccttaagtgttttgtttctgatgtcagtggcagaacccatccgcgccgtctgacggtacgtccgtggccatcatcgaattcatcatggtcaggtttaaggtaaggtttttgggttatctgttgttgttgaaaatagttaaccgcttccgaaaaggttttcccctgattgcctttaagcgacaaaatataatcggcttcactctcgcgtagttgctgagcaatcgtgcgttggcaacccatcgcatccatcgtcacgagatggcctttcaatgaaagcatcgataataatgccggaatggccttaatttcgtttgattttccgtctacggcacattgacataagctaagccctttctcaaccgtgaatgcactcaccatatgtaatgcgctttggtcaattttcttatcaaacgaatgacgtaaacttttaccatcaatcgcaatgatagcccgtttttctgaagagaggtcacgagaaacccattgataaaaatgatgttcaaagaggctcgggtttaataaactgaaacagcgccggaaagtatcatgtgacggaataccccctttgagcggaagaaatgaactcagccaatcctttttgagttgaccgtactgttcaatatcagtccaggcgttagccccagcaatgacagcgcataccgcgatcactaagatatcaataacacggtgtttgacctttccctgacaacgtgggtctggaaaatcagaaaagacatccactaattctttcattagcgtccctctaaaaatgaaagaattatccactaaatattttcatgcgtaacccctgacctgactccactccttaatgcgacagaaccagaaactgctcaagcagatagagagcaaatttaccgctatttttatgaacaggcagggctattactcgctgataaagtcgatgctcgatttcaagaaatggcagagttgctgaaaacggccccttattctggtgtgaaaattagaaataatgttgatgagtcgtacagaaaattaatagttcctcattttccatttatcttgttgtaccaatacataaaagaaaattcaaacatctgtattcttagagtgttacatacatcaagacaaataacctcgacattttaattgctaagggttttacaccagaaccaccgaaatccccatattgtataaaaataggcttagcgtaggatatttcccgttttccaagctgactccttagaggttattatgacaaactccgatgtatttgaaaaagcccgctacgtgattcatgaatcagcaaaggaataggaaagtcaactttcctattcttcacaatcttttacttccgactatatccgagcacttgcagatcacaatttgatctcggctgaggaatgtttgaatttaagagatgaactggttactgcttttggcggttcgtctttgaaaaagtccattgaaagagctaaataatctgacttggattgactaattgatagcaattttgacaaaatttaaagagaatatcaaaaaatagaaattgatcattttaagaagaaactttaatttttcttttcttctttcaaaatacgaaagatacttgtgcgccctactccatcatgaccgttaattgtgtatatattattatatgctaacgaatcatgctaaaataaatttttatcatgtctaatgatgaaactttgaacacacttcttgccaaaaagagcgttacgttgaaaaatatcacatccaatttaaaatacatgccagcagcaattttatgtttcttttttatatcgaatgcaaacgcttctatgttgaaagataaaattaaaactttagaagcacaaggttggcaagttggtgtatccatacttgactacaatggtaataagattgaatctgtaaacggagacgaacgattccccttagatagcacagtaaaagcccttgcatgtgcaaatatcctcgcaaaagtggacaataaatctctgagattggaagactctgtacttataaaagaaaaagacattgttacatactcccctattaccgaagggtatgtaaataaaaaaataactttaaaacaagcttgcgaggcaaccaccgcttttagtgataatacagctgctaatatagctatatcgtcagtaggcggcccaagtgaactaactaaatttatgcgttcaatcggcgataatacaactagatctgatagatatgaacctgacttaactattaaccctgagcatgacttaagagataccacaactcctaacgcaatgagcaatagtattaggaaactattaactggaaatgttttatctgaaaagtcaaaagagcaactgaaggaatggatgatggggaataaagttgccgataatatgttaagatccgaactacctaaaggttggtttatagcagaccgttcaggtgcaagtgactatggtattagaggtatcacttcaatggtttggtcagacaaagagcctccattattcatcagtgtctatcttagaaaaagtaacacttctcttgaagaacgttcagagaaaattgctgagattgggatggttatttttagcaagtatactcactaaacgactaccggctgatgccggtaggtttatcggcatggttttcgatacactgaagtataattttgtccgtgacattgccaccggcagagatattttatcgattggctgcataaagagtcatcattcccacctccgtataaactttctctgttaatgcgacagaaccctgccaacgcacaattgctcagcaattacgcgagagtgaagcagattatattttgtcccttaaaggcaatcagggaaaaaccttttcggaagccgttgactattttcagcaacagataacccaaccaccttatcttaaacctgaccatgatgaatttgaagatagccacggacgtacagtcagacgacgcggaagggttctgccactgacatcagaaacaaaacacttaggttcttggccggatattcaggccctcctggtaacggaaacgagacggcaagaacaatattctgacacagtcacctctgattttcgttattatttaagcagttgtcaggatgttcccgcctttcacgctcaccctactcgatgcaggaggtaaatcaccgcaggaggtgatcgaaatccggcaaaacaaatacctgaataaccgcattgaacaggcccctcgccatgtcaaacgccgggtccgtccgatgctaggatttaaatcgttccgccgggctggcggggatcgaactcgttgccatgctctccctgatgaccgcttaatgcgacagaaccccgacaaggtccgtattccatctgacctgcattcctccattcatataaccagcaccagacatacatgggcaaccacatatacttggtgctaatcatatgacgccagtaagaaaacccgtcaaaaaattaacgtttaggttttcctgctgctatagctttatcccttttgtcctttcgcttttctttattctttgcatttttacttttaattacaggttcaggttcaatagtaaattggacatcaaaaatacttttattcgctagtagactattacccaggtgtgggaaaatatggtcagggaaggggattccttgcttggttaataggctaccaaattctttgttagatggcgctcttccaagcagccccaataatctggacaggatcatttctattttattatcttccgtcacattaacaacctccacacttgaattatttttcaaaaaataatattcacccttctctttcacagagcgataaaaagagtcacttgtattctgtgattgggggttagtccttgtcagcttagccaagtcctcgctatcggaaaaataccatatttggtttacttgaactgccattgacacatttccatcgtgcaacaacgttttttgcgtttcataatataccgaataatcagcccttccggtttggctacccacgtgtgacatatgggcatcatcatacggtcatgctcccaatagttagattatccttgcaagatagtattcacgctcaatgaacgttccgatgattttgtcatgcaggatttctgatttagagtagcagatcgttttccgattcagcctttttattcgagtacgcagggtcagattcattctttcgatgcgttgggtaaatttctttcctctgaggtgagttctctcaggaaggcaatcataaacagcataattatcagtacaataatactggatttcaaacgatgccagaagcgccaacagtttttccagcgtttttttactgcgatcgccaaatacatgtgcgatgatttgcttctggtttggttcccacgcataccagagcccgcgttgattcttcttgttgccgacaaatgacccctgctcatcaatttcacagataatgtgaatctcacttcctgccagaggccgtgttgttacttgtctgggttcatgttttttaacgtgcgaagcacggtattgatcccgacgttcaaaacacgtgcagtgtctctgatcccgccgttatttatcgccatatcagtgatttgttctttcactccgggtttgcaggcttgataggtgtaattcagttggaaggttttacggcaggcataacagtgataacgcgggtgcccactgcttccttttccatgccctttgacctcctctgctttgtgacaataacgacaaaccacatcaactttagccatatctcaccagtaataaaaaatggaaagtttactacaataatctaactattgggagcatgacccaacaattgcgcctcttattgacaataattttggatttaatacgacatttgtgattgatggtaatgcaccacaagaatttgatggcggttatttaaaaacaaatggggatttacatgaaaaaataattttatttccccttataacaaaaagctttttaagtggcaataagacttcattttacctgatagggaaaagtgatccattaacgtataaaacaggaacggctaaaaacattaacctaaattacatatatataaaaaaaatgctttcagtttggacgggtagaaagaacaatgacatgccatttatgacctatcctaatggcgatattgtttctggcgaagttagacctgaatatgaaacgttaatgggcattcttgaatcaagaaacagcaaacagactaagatgtagtcattcagacttaatctgacagtcgcccactttgatttagtgcctgtcagattaaattcggttgaacgatacaaggaaggcacccatgaaatttctctgtaataaacgcgtattatcctccctatttgctgtgtttttcatacaaggatgcgcacaaagcgactcattctctcccccgattaatggagagaatattcattttacgaccactatgcctgacgagttggatgctttacccatttcagccatgtatcgttctgaaatttgccgcaaagaacgccgaaccgcgaatatgaagtcgtattctgttccgggttttcatcgtgctacctaccctctatcaatcgatcagtcaaatcaagttgaggtcagtgtccctaaggaggggggagggaagtgtgattggaaactgagtaatattactttcgaagtgaagctgaaagatacgtcaaaaattgcgcctcttattgacgataattttggatttaatacgacatttgttattgatggtaatgcaccacaagaattcgatggtgggtatataaaaaaaacaggtaatttaaatgaagaaattactctatttcctttactaagagagcggtttttagggggacatagtcaatcattttatttggtaggaaaatatgatgttatgacatataaaatggataatggtagaaaaattcatcttaatgtcttatatgaaaaaaattttttaactcattggaatggaggaaaaaataaggatgcagatacatcaatgacttatcctgacggcacaataatatacaatggtgatgtaataccagactttgataaattaatgcgtattcttgaatcaagaaacagcaaacagactaagatgaccgccgccggtattaatcccacttatctttatgaagatcaggcatccggcaaacgcgaagatcgtcctggactggaaaactgcctgaaagcattgcgatcaggagacacactggtcgtgtggaaactcgaccggcttggacgcgatttgcgtcacttgattaataccgtacacgatctgaaccagcgcgatattggcttgaaagtactaaccggacacggcgcggctattgataccacaacggccgcaggtaagctggtcttcggtatttttgcagctttggctgagttcgaacgagagctgatttctgaacgtactttagcggggttggcatcagcccgggcacgtggcaaaaaaggtggacgtctattcaagatgacggcggcccaaattacgcttggcgatggccgcgatggggcaactggaaaccaaggtgagtgaattgtgcaaggaactggacattacccggcaaactctgtacagacattatcccctaatggggagctgcgtccagatgggaaaaaattgcttggccgggtctggttgtgggcttatatcacattgataactcaccagtatgggacgagtgaagatcatatctgccctaaccgaaccttcaaaaagggataatctcgtgaccataagcattaggctcactgtcgcaataacactgcttactgcgacacagcccatattagctaaaataccagaaaattttgtctataccagctccggtgacctcgaagcggcatcagtcattatggcgcgtagcgacattggcggtgcgcagatcgtttatgattggcgcttactcgaacctgagaagaacaaatacaacttctcgcagattgagaaggatctggctcgtctcaaggtagccaagaaaaaacttttcatccagatccaggatcggttttttgaacaaaatgcccgatacgttcccgattatctgatgaatgatgccagatacggtggtgggatatcgccacaatttgataatcctggcgaaggaaagccgattggttcgggttgggtggtacagcaatgggatcctgctgtgcgccaacgttatcaggctctgttggcagcgattgcagagcgtttcgatggtcgagtctatggtgtgaacctaccagaaacagccattgatcttgacgaaaaaaagctacccaagggattttcctgcgataactatttcgcaggcgaaatggaaaacctcacctttacgcgaaaggtgttcaccaaatcacatgtggtgcaatatgtaaatttctggccgtgcgaatggaacaacgaccacaattacatgggccgactgtttgagttcgcgagtgccaataatattggacttggcggcccagatattgttcccaaccgcaaggcgcaaatgaagaactcatatccattcttcaacaaatacaaaagtaagctagcactcattgccatggcagtgcaggagccgaccttgacctacaggaaccccaatactggtaagccctttatcaaggacgagtttgtagaattcgcagaagattatctcggtgcagatatcattttctggagcacgacgtctccttggttgacaaagaaataggtatcaatcgctaaggacagaacccggtcaactcctcgaccgcacgaaaaagtttcgtgtcagtctcacggttctagttaaccttatatcttgattatcacttttacagagcgataaccaagatataagataccgtctcagtcattaaactgcaagcggtatttctgcgttaaataatgtgcctgatttcatcacgccataggctaatcgtaagagtttacgcatcactgcacaaacaccgactttcccccctttatggcgtgctgtcagctgttcccactgctttttcactactttattgcaactgatcgctgccagcgcaggcatataaagtgcttttcgcagctcggcacttccctgcttcgagagatgagcccgcccttttagttgtcctgattcatgtaatttaggattaagcccagcgtaagccaccacttgcccactatgatgaaaccgtgaaccatcaccaatataagccagcagtgttgcgctcaaccgttcgccaataccgggaatactttccagtaaccccttatttttcttcagcgaaggcgagtcatcaatgtgcttttttagtttcaattcggtgtctttgagttcttgctttagcagggtgattatctttgcatgagaatcacaaacaacttcatccgccacggagaggcgattctcttccgtcaaaagcatttcattcagcttattgcgatggcggactaaagccagtaattggcgttcacaaagcggcgcgggctgccatgccggaggatgctgactggcgcaataacgtgctatcagtttggcgtcaattttatcggttttattgcggagtaattccgctttaccaaaggcacggatttgtaccggattgacaacactgataagaagccccttatccgaaagataaagtgcgagcggatccccataaattcctgttgcttccatgcaaaaatggtaatttgaggcgggtttaagccaattaatgaaggcgtcgaatcccttaaggtcatttggaaaatgcttccttttgtaatgattttcgcctgcccaaacggcgacatcaaatttgtgtttggcgatatcaataccgactacgatgttatcagacataaggttatcctctttgtcagagacacaggagatatcgccatgattagacttataaaatagatgctcgaggcacaagataccgttcaatcttaaaggcgatacagaagaggctgttgtggtttactctgaattacgaactccattgaatgacacatttcaggttcaggttaataataacaaactcacaacagcatccctgatgatcagtcaggggattatcgctctgtaaaagtgataatcaagatataaggttaattaataattgatattattcgtgcaattaatgtgtatgttacttttgttgattttgagctacacatgtcattgtaagatttggaggttttagtctgtatcatacttaactcatttcctaaacacatccttgcgacaaactcttcttgaggtgaaatacgtatatcatttatgctaaacgcatcctcttcagcattaaagcgcactaagtcttcgatatattcaaatgtattgtttctatacataagcctaggagttgcactatcatttagtgatacaaaataaatttctggagaataccaaggtatattattaccaaataaattaacattcgaatcttctggaacaaaaccaagagcatagccaagatggcgcaccagtagtatatacatatatcgttttactgcttctccgttgttatgaacatcgctaaaagttctcatcatcatagtcatacgttcctcattcatttctgcaaggtaattgtcaacatatattccgtattgaccagctagattagtattccttagtgccagagtgtttacatgcccagtgtgtggtatgtaggatattgcaggttcacgaccggctattcctgataacatatttagtgctgaagaatagccaattaaaaaatttgcctcctccccagaacgcatatgtctaatagttagcattggatatatatcacggacgattcccctccaaaaatctaccgctaattcaatctgatctgtataatcaatttgtcgagtgtgtccatcaatttcaacataaacgctggctccactaggtgatggcgtgttataaagaatcactcctccataagtttctacggggttataaagtgtaggatcaccatctggattggtatgtgttatactggttctatattttataatttcactggccttggcactacctatgaaataaaaagaaaaaaccattaaaaataaagtagtcatcgatgataaaaatttaaaataaatttttatattcatggcatcccactattcaattttaattgaaaattaaattcgtgtcaattattgttaaataaaataatgacacattgatattaggaaaatttctaccgccctctgaaggcggttattaacaagtttatgattaatgatagttatggtaatccttttttcacgccactcacatctgctccctctccgatccatataccatcaacccatgatccattacagtttatattaattttttgtcctgtaagcatagctgtttgcgctaaagctaaaaatccaggccctccatctgaaccataatctttacgtaacattaatgctgttccagttttatttttctcattctcttttttaaacattattgtaatacgagtatttgtgtcatctgcgccaacataatatcccatagctacaccagtaatataacctgtgaattgttcgctactattacaccttagtgcatcctctactgaagaggcttttgttattgatgaaataaaaaatagaaacaatgcaactatgggaattaatgattttaatttatctctcattttaaatgtcgccttaatttattaaaattaaaggtggattaaaaaacctaaataacgcactaggttgccaatatatacttttgcatatatatgtttctttgtcttcattttcggaataatataattaaacgcagcttatcaaaataaattcgatacatatttttgttaatctaaataaagtttcataatagtgatacaccccctttttaattttctgctgttgctgcaatgaggccgattccatgaaaacttccacacacttaatcaattgccacataaactgacagcaatggttccgcgttactgttttatgtagagattgccataggcgttcaattttatggttctgtcgcattaacggcgagttaatcagagattccgcgagtggttgtttttttatactgtcaatcgataaaattgttccgccgctgataaacattcaccttcctcttgggttctgtcgcattaagcgatcatcaggtaagctcccctgtttttgagcgagtccagagcgatgcccctgatccgaaaagcgttcaaacgtctgcactaccctgttgatattatcgctcagtgtgttcgcggggatctggcctacgcgctgagcctgcgtaatctcgaggaaatgctcgttgagcgtggaataaccgtcgatcattccacgctttcccgctgggttcatcgtctgatcccgttgagggtcaaacgctatcggcggagcaagcccgccgttgggcgtcggtggcgaagggatgaaactgatatcaaaatcaaagggcaatggcgtggttctgtcgcattaacagagaaaatctgagtcaatgtggggttggttgtattttatgcagctaatcggtaaaacatttctgtcggtgacaatgccttatcttctgattgtgagtattgtcttttacgtcgcatcgaaacgcgctctatccccgctaaaatcgtttgggcccggcgaaacgatttaaagcttaacatcggccgtatctgacgtttgatattgcggtgatcttgctccactcagttgttcaggtatttactctgtcggatagtgagggtttcctctttgggtctatcggcgttgagcgtcgccagtgcagtggtattcgccccacttttatcaagggtcacgacctcaggctcaccgtgatggcggatcgccttgcgaaagaagcgcaacgcggcgggagcatcccgcttggccgtcagcaggaagtcgatagtttgcccggccgtatcgactgctcggtacaaatattttcattgtcctttgattttgatagaggtttcatccatgcgccagcgacgccccacaggacgtttatgtcgacgaaaagctttacccagcaatggggtaagccggataacccagcgatacagagtggaatggtcgacggttatcccccgctcagccatcatctcttcgagattgcgctggcttagcgcataagataggtacccgcggacacactgagcgatgatatcaacgggataatgtaaacgtttgaaggtttttcgaattaaagacacggctcactctgcaaaaggtcacataattacctgatctccctttaatgcgacagaaccccctactgtgcctgctggatggttggcaaacaatggtatgtggacttctccgtactttgaaggatgctcaaattacagttattatttctggagtgagttattggaggatcgggcttccacttgcatggtggctctcgcagttttctctcggccctgatggtgtcgggtggggaatgtgttccgggctgttcatcgcttgttttataatgcagattagattgtaaatgctattacggcaacgcatgcatatttctactaaattagaaatatagaaatttatttatacattgataatgcgattctatttcttgtacgacagtgaaggaatcttcagaataaatttttctcaataggccgcacacaggcggccgcagattattggcaaaattacagatataatgtcttgttttatatcataaataagcaaatattttgtgtgtttttttccgaattctgtcagtcatatcggaaaacaggttttatttaaactgggacttaaatagccgctcgaatttattttactttatctaatagtttcggcctgtcacccgaaaagtccatccaaggattggtattcagcatttctgaatgggctacgctgggatcctcataacgcatcacaaatgtttccggaccatgtgcgtatgccaccagtaaaccttgatccgcattaatgaaaccaccatgagggcccaatcccggatagctgaggcgtatagcctgatcgtttggtccaacttcattaactaacacgttagcagtcactccattgttcagaacaaagaaccaatttaatgggccgcctgaaatcacagtcattacttcgtcaattccggagccatcttcagaagaatttacatgcagtcgaccaaatttactcagtacgtattttttcatttcatctgtcatttctttcatatcgtaaacttttggataagggggaacatctacttctgtagtagataaatagccaccgcgattaactgctggagttcgcccagcaagccggatttgctccagaaaatctgcgcggtttaaattaaagatggaaataagttttttcttctcttcatcgttagttgcacgggtttttgatactttgataataggtttagcttcttctgggatagataccaaactaatccgcacgccaacttcacgcagaattgcattggcattatcaacaccaacaacgtcattacgtccatcactgaattttatacttacgctactcatattaagcttcctcatttaggttgtttttttaaacagttctctatacccaatggatttcaaagggttctgttgcaataagcaaagccttggtaatgtaatatctcacttatttgttgataaaggtgtcgtcaatgtcgttgatacgaaaagccttcaaacgtttacattatcccgttgatatcatcgctcagtgtgtccgcgggtacctatcttatgcgctaagccagcgcaatctcgaagagatgatggctgagcgggggataaccgtcgaccattccacactgtatcgctgggttatcagaacaccattgctgggtaaggcttttcgtcgacataaacgtcctgtggggcgtcgctggcgcatggatgaaaccgacatcaaaatcaaaggtcagtggaaatacctttaccgggcggtcgatacggccggtaaaacgattgattttttattgaccgacaaacgagataccgcagccgccttgcgtttcttccgtaaagccctacggcaacacggggagcctgacatcatcaccctcgataagagtggggccaacaccgccgctatcgccttgctgaataccgataaatcaaaggaagaggccataaaaatctgccaggataagtttctcaataaccgcattgagcaagatcatcggaatatcaaacgtcggatacgacccatgttaggttttaaatcgtttcgccggacccaaacgattttagcggggatagagcgcgtttcgatgcggcgtaaagggcaatactcacaacccgaagataagacattgtcaccggcagaactgttttatcgattaactacataaagagtcatcattcccacctcagcacaaactttctctgttaatgcgacagaacccatcaggtaagctctctattttttagcgaatccagaacgatgtcccttatccgaaatgtgttcaaacgcctgcattatcctgttgatattatcgctcagtgcgttcgctggtatctggcctactcgctaagcctaagtaatctcgaggaaatgctcgttgagcgcgggattgccgttgatcattccacgctctctcgttgggttcatcgctgggttctgttgatcgttaaacgttatcggcggagcaagcccgaagttgagcgtcggtggcgaatggatgaaaccgatatcaaaatcaaaggacaatggcgttacctctaccgggctgtagactcagatggtaatacggttgaatttttgctgaccgcacatcgggataaaaaagcggcattgcgtttcttcaaaaaggcgatgcgtcaacatggacaacctgacggggtaactcttgataaaagcggtgccaataaagcggcgtaggacgaaataaacaaagaaaaaccgaaaaataagccgattaatatcagacagaataagtcccttaataacctgattgaacaggatcatcgcaacgtcaaacggcgaacacgtcctatgctgggattcaaaaactttagggggactcagaccctgttagccgggattgaacttgcgtaaaaatcactcaagatgattttgctcgcgatctctctgttaatgcgacagaaccagcaaaagtatcatcaggccggccataatatttttattaatgcattaataaaatatagtaagcgttcggggaaccacacctagccagggtaaattcacggttctggtgcattaacgtgcatacatggacgccccttgtttgccaaataatcatttgtcatgaccaaaactaggttaagattgcagccatacatccggactttagttgaggccgtcgcctctgtccctgatggaattcgctgactaggctcttatcatttcggcgcgctatgagcgcttgcacgacaccagagtttcctgatcacggtccgacctgtcttgccatcacttctcgattgcccgtgcaacctttggaaactgcttttatatggactcccttcatttgcactttatggctttagtcgcttgtttccgggttcccataatctgcctcaaactccctgccatgcaccagcaactcccagataatccgggtatttttattcgccagcgccaccacagcaacattagtattacgtctcgacaacagactattcagccagttttctgttcaaccggttttctcttttacgtaccgtaccaccgccctggctccatggatcaacagtgtccgaaagtaattgtcaccctgtttgctgatcccctgcaaggttgacttacccccactcgaatgttatcgggggaccagaccccgccatgccgtcaggtcactggccgttatcgggccgataccgggtatttccgataatcttcggctgtctgcattgccacgatgccaatgttgaatgtcctgttccagttccgtaacctgacgatcaagctccttcaagtgttcacccaaccgctggagcagttgcctgaaggtatctggcaagctattactggcatcctctagaatctcgggcagtcgtacggcaatctgtcttatcccctgagcgataacgatcccaaactcgctcagcctgcgcgatcttgaagaaatcatggctgagcggggtattgtcgttgatcattcgaccctttatcactgggtcattagttaacccctttgcagaataaggcgttccgccaacacaagcgcaccgtggggcggcgggggcggatggattaagcctatctcaacattaaaggccagtggcgctctctttatcgggcagtgggctctgctggcaatacggtagacttcttgttgaccgccaaccggaacagcgatgccgcccgtcgctttttcaacaagggcgttcgccaccagaggtcgtgacccttgataaaagcggagccaataaagcggcggtggacggcctcaatgcgggcaagcagaagaaaaaccacatcaaaatacggcaaaacacatacctgaataatctgatagagcaagaccaccgaaacatcaaacgacgggtgcgggcgatgcttgggttcggctcgttcagaagagcccagaccctgctggcaggaattgaatgggtgcacatgatacgcaaagggcagttttaacatccacaagggcaaggattgtcatcggcacaaccattctatcggctagcagcctaaaaaatcagctaaccgactttatgataactttcaaccagtaatgcaacacaacccaaattttattgcctctgcacactacatcacaaaaaatgataatttaatggatgaaaatttggcgatttcactctgaaataataaattaaaaacctataaaatcaaattgttaggcgttaaatctcgttggcgaattattcattgaaatgcttgcgtaatacgacttgaatcattctctccagctcttcctggaaagctttaggaacccgattaaattcatagctaatggacctatcctttacgcgcttacgggcgaaaacatccttttccttaaactcccagatcgggcttatctgtgctttggttgagtcgtttttagtcgctaatttactggtgatttgcttaaagaacttaagtatcaggtttttcatttcatctgccgcaatttggtcgctgttccccatctgagcaacaccttcacgcacatcatttaccacatcatttatagagagattgttgctcttgatgaaaacatcaatgtccaatagcaatttataatcagggtatgacaactcggattggatcgggaaaatcgccaccatatcattggaaactgaggcgcactgtatggctctggttacttttgcaggagacattttttgcgatgcagcgatctctttttgggtcatgccaccatcgcgaagttgtatcaggcgcaggccgatttcacgaatattatgctctttcgctgtttggatgtcagctgccagctgtctggcgtcttcactgctaatatcggtattggtaacaaggatatttaagccgatcttgcaatacaaggcagcagcacgtctacgcgagccgtcgaggatttctatcttgtcaccaactttgcgtccgatcgctgggaaaaattgctgaagtttaattgttcgaacgatgtcactcagcgattcttcagtgagtgcgctctggtcacggccattaactgagaactggactatggtctgtgcttcgagcctatccgctggaatgtgctcctggtggaacacagctgttttacctgacgacaacgtaaagcgttgttctgtgcctttcacctttgaagactccggtaatgattcagtgctaagtattctaccgattgtttttcttttattttgcatgattacctctgtttgctcttaaaaattcaacacgatcaaaaactgacttggcaaagtcttctgcggcatttttagcgttcttcaatgcttcactgcttcctatgtaggttgaagggtttgccgaaattactgtgtcaaatgactcgccacaccgctcgaacccatcaaggcgaggtagagagaaatcaagcatatcaccaccaaaaatctcttttgccaagctatggcatagcttgtggtccgttttgtttaatagcttagacataaacccaatattgcccatcaagcttgttgacgcacctgttgactcaatcaattcaaccaattcaggcagtcgagcgagatactttagtgttgaatgaaagtctacctgagcgggtggaattggtgtcattaggatatccgccgctgtgatagcgttagataaaaatgagtcgagatgtgggccgctatctatgaagataaaatcgtaatccttgctgattttactgatgatattatctcttaaaacagtatagatatttcggcctggtagatgctctgcgcatagctcttcccaacgtgaagcaataaatgcatcttcaattgaagctgcaatgacatctacgccttgcacaacagaaggtatgatgaactcagccagcaattcttcgcgacttacatcttgcagcatggcctgtgcggaggttgtctccacagaaccgatagattgctcgtggtttaaaaacatcgttgctgatgcttggggatccaggtcaataaccaatattcttaagtcttcatagataagatgcggatgcgtgcgcagggcatgagccagtgatactgtactgacggttttggatacgccacccttcaggttcccgacaaaaaaagtgaatgctccaaagtagcgatcacggtactttggtacaccacgatgatgatagaggtcaatgatgttctgaagtgtcatcgcgtatttggaagaggagcctgtttggcgtttctcgaattcataaccctgctcttccatttcgctgacagcataatcaacacttgcacgcgttaattttggcagtttcgctactgcagcttttgaatacacttggtaatacgatgtttcatttaactcttctttctgagtctggatctgttcggttaaggactgtaataagcgcacggagcgctcagcaactctatctaattgtttatatgcatcattcattatttcaccacatatgtagattttttaaatttcggcaataatcctacatacaagtatatttataaatatgcactattcaaaaaaataatattttaatttgaaacttcgccatcgtaattgtatgtataattaattgatatttaaaatattctactttttaatttcagggtaaaatcgccaagtttttatccgttgaattatcatttttgtgctatagttgtgcagagacaataaggttctgttgcactaacagagaaagtctgaatcaatgtggagttggttgctctttattcagtcaatcgataaaacagttctgccggtgacaatgttttatcttcgggttgtgagtattgccctttacgcagcatcgaaacgagctctatccccgctaaaatcgtttgggatcggcgaaatgatttaaagcctaacatcggccgtatccgatgtttaatgtttcgatgatcttgttcaatgagatgattgaggtatttgtttggttctgtcgcattagcagagaaagtgcatcaaaagatgaatacgattattttttatgcagcgagttgatagaaaaattcggcgggtgaaagcggacattgcggatattgtccttggttctgtcgcattaacggaacttcaggtaaacttcccggtttttgcgcgagttccaaacgatgcccctgagccgaaacgcctttaaacgtctccattatcccgtcgatatcattgctcaatgtgtccgttggtatttggcctacgccctgagtttgcgtaacttagaggaaatgatggttgaacgggggattgccgttgatcattctaccctttcccgttgggttcatcgtctgattccgttgcttgtgaaacgttatcggcggtgcaagcctgatgttgggcatcgctggcgaatggatgaaaccgatatcaaaatcaaaggccaatggaaatatttgtatcgagctgtggactcagacggcaagacagtggattttttgttgacggctcgtcgggataagtcgtcggccttgcgtttcttcaaaaaggcgatgcgtcagcatggccaaccggacgtggtgacaatggataaaagtggcgccaataaagctgcagtggatgaattaaatcaaggaaagccaaaagaggaagccattgttatccggcaaaacaaatacctcaataatctgattgaacaggatcaccgcaacatcaaacggcgaatacatcccatgctgggatttaaacatttccggcgagctcaaacgttattgagcggtattgaattggtcagtatgttacgtaaaggacaatatccgcaagaaccagagtgttttctttcacccgccgactttttctatcaattggctgcataaaaaacaattacatcattttctcttgctagcgctctgttaatgcgacagaaccctttttgcgaggtcggaaagccttgccgagcaggggcaccaaacgtaacacccagcgaggtatcgtggcatggtcgacctcaatgccgcgctctgccatcatctcttcgagattgcgtaggcttagggcataggccaaataccaacggacgcactgggcgatgatatcaacggggtaatgcaaccgtttgaaggcttttcgtatcaacgacattgacgacacctttatcaacaaataagtgagatattacctagatggtgtcgtcataaataaattcatgtaataataaccctatattacatgaatggatgacttaaccatgagcacacccgtacaccgccgtcacgatatttccgatcatatttggagtttgcttgaacctcacctgccgggacgtaagggagcctgggggcgtgttgcttatgataatcgattatttattaatgccgtgttctggattttacggacaggcgcaccctggcgagatttaccgcccgattatggcgactggaaaaatacgcatcgccgtttttgtcggtggcgggacaaaggcgtatgggaagaactgcttgaagaactcatctttgaacccgatttcgaatggctgatgattgacgccagtcatattaaggttcatccccacgccgcaggggcggcaggaggcaatcaggatatggggcgcacaaaagggggctcaatacaaagatacatctggccgtggatgcgcatggtatgccgatcagagcgcttattacaagcggtcccacagcggattgctcacaagctgaggccttgattgacggaatagatgcagaacatttattagcggatcggggctatgacagtaataccgttgttgaacaagcagaaaaacaaggcatggcagcgcaaattcccggccgaaaaaatcgcaaagtgaaacgagaatatgatcgggaactctatcgactcaggcatttagttgaaaatgcttttcttcatcttaaacgctggcggggtatagcgacccgttatgccaaaaatagtgcctcatttcttgctactgttcagatccgctgtcttgctctttggttaaatgtcttatgacgacaccatctaggctttgcttattgcaacagagcctcctcacctgataatctttgaggtaatcaaattgagtgatacctggttacccccttgtttattctgcattaagaacaattttaagagcttgctcctttgccgcgttaccaaaaacttcataggcggtttcaatttcacttagcgaatagcgatgagtgaccagcttttcgggtgaaatcttgccggattggaggcttttcaacagcatcggtgtgctgcttgtgttcactaatcctgtcgtgatagtgatgtttttgatccaaagatcttctaagtgcaattcaacggattttccatgaacaccaacgttagcgatatgtccaccagcagtaatgatatcttggcagatcttgaatgttgcagggataccaacgcactcaattgcgacatcgacacccaggccatcagtgagcttctggatgacttccaccacattttgatgtgtggggttgatgacggtgtcagcaccaaactgttgggcgacatgaaggcggttatcatcggtatcaatcatgatgatatgggcgggtgaataaaactgggatgccagtaacgcagaaagccctacagggcctgcgccgatcaaggcgagggtattacccggttgcaccttgccattgatgacaccgatctcaagacccgtaggcaggatgtcactgagcattaatgccgcttcttcatcaatgccttccggcagacggtgtaggctgttatctgcatggggaatacgcactttttcactctgcgtgccatcgatcttatgtccaagtatccaaccgccctcttcacaatgggaataaagctggcgtttacaataacgacaacgaccacaaactgtgatgcaggagataattactttatcacccactttgatattatggacagattctcccacggattcgactatcccaatcccttcatggcccaatgttcgcccggcatctacagttggaacatcccctttgagaatatgtagatctgttccgcaaatggtggttttgataatgcggacgattgcatcggttgactcaatcagttgagggggggcttttacttcccaatgcttttttcctgcgccatgataaacaagggctttcataaggtctctcccataggttatttgtttttttgccgtgttagtccaattccttcaatgagtgaaaaccactcaatattaaaaagtgtagtctctttcacaataaaattggaacaaagacatcgttcctcagtgaagagccattttttctaatgggatctcatcagacactgagtatttgaattgcttataggagataaaggcattttaagggcagtgtcgcgttaacggcggcaagttagcaaaagtggtgttgccggttatttaggcagccagcaaatagaattgttccgcgggtgataatccatcactttgtggatgttgatattgccctttgcgtatcatgtgaatcagttcgatgccggccaggagcgtctgtgcccggcgaaacgatttgaaccccagcatctgtcgtatccgacgattgatactacggtgatcttgctcaaccaggttattcagatacttgctttgcctgagggtgatgttttcctcttcaggtttgtcggcattgagcgtggccagagccgcagtattggcgccgcttttatcgatcatcaccctttcaggttcgctgtggtgacggatggccttgcgaaagaagcgcaacgcagcggcggcctaccgaccgtttatgccggcgaaatgccttatccagcaatggcaccagacggatgaaccaacggtgaagcgtggaatgtcaacgataacaccatgctcagccatcatctcctcgagattgtgcagactcagggcataagcgaggtaccaccgaacacactgagcgataacatcggtgggataatgcaggcgacggaaggcttttcggatcaatgacatggtcaggtaacaccataaaaaacaacatgttacccgacgattccttaatgcgacagaaccctactgctcgcctaaaaaataatcaccgcaatttttgctaatttgccgtcgttaatgcgacagaaccagagaaggtattgtcaccggcagggaggttttatcgattggctgaataaagagcaaccaactccatattgactcagactttctctgttaatgcaacagaaccttcatagggctatatctgagatagtaacgctaacataacctcaataaccttctctttattttgaacgataaaaaaatgatcgcccgggatatattgtacagttagaccttcgctggataattctgaccaggcatagagttcaatcggtttaatgtctgggtcagaatctccgcttaaaactgttatcgggcttttcagcaggcaccgttttgcctgataagtttcagccattttaaaatcagcctttaaaaccggcagcaagaaatccataagctcgctgtttaacaggacttcatctgtagcgccattcattttccgtaactcacggataaattcatcgtgaggtaagtcgtgagtatcggggaaattatgtctcaaatgcggggctgtgcagcctgatacgaagaaatgcacaggaaccggataaccacaggattgcaatttgcaggcaagctcaaatgccacccgacagcccagactgtgtccaatgaaagcatatgggatcttcgtgataaattccgcatgagccattaactcatccaccagcgaatacaaatcttcatacggcgcttcatcaagccgagttgttcgacccggcggctgtacggcaacaatttcaatgttatccgtaaaatgttcggcccaatcaaggtatgtctttgcagatccccccgcatagggaaaacagaatattctcagcctcgggctattaaccggctctggtataataaacagcttattacgttccaaactatgctcctgtttttccaaaattacctattgatattcgtattgctatgacgtaactgttcctccgctaactcaatcaaatttgtcagagatggacgctgataaaaagctttgagttttagctcaatggtaaaatgggtattaatttttgccagtagacgcacagccatcagagaatcccctcctagctcgaagaaattatcctccggcaaaacagtgctgcgatttagcgcctcactgaaatgggaacagagctgtctggcaatatcagagctaaattcacattccacatgttcttctgccacaagagaatattggttttgcccgaacgtcaataaagccgcggtatcaattttattgttaacggtataagggatagcgtcaatcacccgccattgcgttgggatcatataatctggcaattgaccttgcagatactgtttgacctgatcaatgagttgatgagtactgcccgcaaaccccgaagccgctaccagataaccacagagccgctcatggggccgtttttcaactacgaccacagctttatcaatatccggcacctgcttaatccatgcttcaagctcttccggctcgattcgatagcctcgaagtttgatctgcttatccttccgccccagacacagcagcgtgttatccatggtaaaacaacccaaatcgccggttttataaagccgttccccgttaatatgggaaaaagtatcttcaataaacgccgccgccgttaagtcgggacgctgccaatatcctttggctacccccgccccaccgatgaataattcaccgacaacccctgctggttgatggcaaccactttcattgagaacatacatccgtgtattggcaataggagaaccgatgggtaacaccccctgactcctttgcggatctgccacgatgttcaatcgctctacgcagcaacccacgaccgtctctgttgggccatattcattaaaacacatgctttcaggagcaatagcgttgagataatccagatgggtgcgactcatctgctcgccaccgacaacgatcactttaacgtccagcgatgtctgccgctgccctaaactgagcgccagatgttccagttgtgaaggtgtcgttttcattaatcccagtggtttgttcagttctaataagcgcagcaatggctcatcttggctatcctgactgacttgcgaggagaacaacatgacgtgtccgcgtgccatcaatggcaagagcaaactggtgatggtggcatcaaacccgaaggaagttgtcacggggacgcccagcccacccaaatcatgggcctttgtcggcatataggtttgtgctgcccagttgagatagttattcagccctttgcgataaacttcaacgcctttcggtttgcctgtcgtaccggaggtataaatcatgtagcaaaggcagtcactttgggtgatgcgttcccattgaggggctaaagggccaaagttcctgttgttgtctctgctcactgcttcccattcgcgcgtcagctcaatgactggggtattaaaacacgccatctccgcaaccaacgacgcatttttgccctccacgacatctccctcaatcacgatggcatcagggcaggcatcctcgataatcagcaatagacggttaagaggtaagtggctatcgacaggtatccatacaataccttccgtcaaacaggcaatgatagtggctagagccaagggactggcaccagagaaaatcacaactctggcctgctgtgccgtttctgaaataatatgtcggcgtaattcatcagcgactttctggctcagagagtataatttttcataactcattctttcggaatgcgatccaactaggtattcaactgctgttaactcagattctacgttcaattggcgaaagaaatgctgacagaagtcttcctgaaagagaataccggtctgattgaatgtcagcacctgacgttgataatcatcctcactcagcaaagtctgagccaatacctcttgattggcattgaggatcatcgcggtacacaatcgctgataactgttgcttaatacaccagaatagtctgtcgcaacatggtcatattgatattcaaaacatagctccacggtgtcaatgtgattaaccacaaacaacgtcaatgggaattttcccccgaccggggttaattcatgttgataagcacgagttccgggtaatgtccaatctgcctgaccgacaaaatagttgtacatgacgttgaatagcggagcctgagagatctgctgcgaatggctgacactgcgcacaatatggctgtaaggaaattgctgatgttgcataccggtgtaaagctggctactcaactgagtggcaatatcggcaaaactgattttcgggtggaagatcactttaattggtaacacattgataaagtaacctatcgttttctccagacgcttatcatcccgcaaagacgtggggacaccgaacacaatcgtttgttgttccgtcaatcggtacagtagcgcagcatatacgataaagtaagcgagtgccggtgaaatacccaagctagaggcacaatgattgaaggagttagctaaatgcggttccagcaaacgccgaaccataccgccctgttcattttttgatggtatgggattaccgatagagagttccaaccggccatctactcccgacaactccttcagccaataagcttcatcaccgtccaagtagtcaccacgcagtaattcattctgccaagccgcaaattcagcatattcaaggatatcggctcctgtgttgtcactgaataacggctctcctgcgtatgtagtcgcaatgttattgagaattaaggcgacagaatcattgtcacaaatcaggtggtggaggcaaaaatgcagaatatggcgttgctctcctaatttgatcagcagaaaacgagccaaaccgggctggctcaatgtaaatggcgtctccaagttgtgctggcaataagtcagtgcccgttgtagttgtgactgatcattatccgaagccccgtttggctcagacagatccacaacggtaacaggcaattcaaccgcaggataaatatgctgtaccagctcctgttcagtttcgacaaatgccgtacggaaagcttcactgttttggatcgtctgtgcaattgcgtccaataatctcgcctgatccaacgctccgaccaactcgtaggtgaccggcacaatgtagagctgtttttcggttaattgctccgccaaccataagtcttgctgaccagcagatgcctgtatttcatcaatctcaaaagtagcaccaacctcaaaagtactatccatctcagtatcagtattcatctggtctttcaccttattcatgccggtttgcctccctgccatttggatgcaaaatcgccgctaagttgcggtgcaactggctgataagagactctgcctcaccatacaacaggctcggagcactggttgtttccagatttttctggacttgttcgatggcttcgtaatcctcttccaacgcttccgccaaatattccacatctaattggcatacctccttgatctcttcatccgctttatggataaagttgaaggtcttcgaccaagtttggttggccgatacgggatggtaaaaagagacaaaaacatgataaggctgcaccccgataatcacgttagggaacagtaaataagtagcaaccatttcccgccgtatcttgtggggtgtttgctggagaacctgagccaaatttttcagtggggtcaggatacggccgtgctgggcaaaagaatccagtgagtacaattgaccattcaatgtgggtgccaaacttttccggtgtaaagactggacatggtaatattcgataaagttttcgatcagcagcttccagttagcttgcaccattctttcgcgggaattcagcagttgatgctgttcaaaatcgattgcggaaatttgatcttcaatagcagcgaaccaattatccagcgaaaagccaagcttaggatcgctcggtatttgccacaacataccgaatctttgttgggcactaattgaattcagcgaacgatattggtctggtatttcgggaaatgtttcccgccaacgagcagcaatcaaatgcccctgatggctgaatgaccaactatgataagggcaaacaaaggcttttttgcatccttccgtgtggttttcaagcctggctccccgatgtggacacacgttttcaaatacagtacagcgatcattgtctactttgctcacgatcatgggaacacggccttggtaatcaaccgtaataaaatcaccgatattttccagtgtctggatgggtgctataaactgcgggatctttttccacagatctttctgttcatcattaaaataatcctgacaaatgtaatgcttaacttggctctcatagatcccaacaggttcagttgcaataaaagagttacgctgactaagcatgtcgatgaaataatcagcataaggagaaaatacgttattcagaacgccttcaccaccgtcaagtaaccttactgtagtatcgctcattaagcatctccttcgaccagagtcatatccgtgaatgtataagattggattatgtacgattgggttatataggtattgtaaaaatcgaaataacgataaacaaaatccagatttggcaccgcaatgcccacgtgttggctcagtctgataaagggagcgagtaaggtgtctgcctctgtttctttgccatgaaggatatccagcaccaaagaggatttaaaatcaggaatggacatcaaatatcccattgactggcgccgaaaattttcactatcgccgatgtatccggctttctcaccaatggccgtacattcgtcaataatcgcttggatcactgttctggaacggctattgcgcatcgccgtttcgacgcctgaacggactaatccacacacggatgccgccgcattcagtgtgtttttagcaaatgctttatgctctatatctgtacagctttcgaagggaatgcccgctcgattgagtaaatccaacgccgctaaaatgttcgcttctgcccgttcttcggtctgttcagggacgccaagatagctggttttaagaaacctcaatttcagtttttgtttgccatgctgagtcacagagaaattgagaaccccacgaataatcgtgacatccagtgcttcatcaataaatggccgttctgtggcaaaaccattctgaaataagataactgggccacgaagccagtgtttatgacgcgataattgctgacaaatatgcggattggagacagttttactgcacacgtacagttgatcgaactctttagccaaaaaagcgctgtagtctgtaaggtgctcatcgacaacaatgctaccgagatcttgactcactgattgttcagattttgtctcatcgatcagctgtatttggctgatcggttgtgcttgatgtcttgtaccgcgtgaagataataaaaaaacctgacacccttgttgtttacattgatgggctaaataacacgcaacagcacccgtaccgataatgcctatcctgagcatattattctccccctatagcgactaataaccggcgtgtcgagataagcaagggaggtaatatcagtaaggtgatcccaataaagtaaagatccattggattaccctgcccccaaatcgcccatccctcctcctgagccagtaagagatccaatacaattccagtgatgagataaataatgaaactactgaatgtcttaaccagattacgcagcgcgaagacacgaccgtgatatattttcggcactgtggtttgccataacgtttgcattttaatgatgcttatccgcatcgtgataaagctaatcgcaatacaagcgccggcgacataaatattctttatctgcgtcaataccacaaaacccgccgcgaacaggaattccaatactaatagcggcgtacgtcttaatatagatggccgccatgccgatataaggctgacgatcaccatggagacgccaccgatagacatcatgtagcctgcatctgcgacagaaaagtaggtggtgaaataaggtacaatagtgattaacgctccccccaccaaaatggctttgaaaaaggtgtacgcaatcatataagtcattttcgacgatgccttgaccaaccgggcgcacccgatatccggaaaaatcgccttccagttcaatttagagagtgtgccatcatcgtgcggcagaaactgcactgcgctgaccctgaacaataacccggcagcaaatgcactgatcataaaggtcaacagatcgatcgtcagcacaatccccaaaccgtagtgtgagaacagaaacgcgccgatgatcggggcaagcatttgtggtaatgaatcgctgaggctgcccaacgaattcgcccgattcagcgaagcggccggaaccagccggaaaaccagcgtgctgtagcaatcaatctgcaacgcagtcaacacactggtcaatgcgatatagagataaaccacgatgttattgagatagccaaagtggttgaagataagcacaattgccaaggctaaacctgcaattccttctgtcagtaataacaccttacgtttatcgtaatgatcaatcacatacccgactaacggcatcagtaaaaaggccggaagcactaataccaaatacatgttagtgtaggcagtgactgacatttgtttttccagcaaccacaacccgaacgcaaattcggtcagctcactaccaaaaatcgacacggcaatgccaatccacagcggataaaacccattgatccccttcattcaaccattaccttttttttacgactacgggcctgtaatacgggtttttctttttgccctgtcatctctgcatggctattcggtaaggatgcctgcgacccggctgtatccctgctctcagccaacgccgattcaatccattcgatcaggtcggtcaatgtttcgcaagccataaactccggtagtctcagagtcatgccatgctctttttgcaatgcagacaaaattttgatcgcggttaacgaatctccgcccaacgccacaaaactttcattcatactcaacccatgttgcccaagatgagtcatcagcaaacgacccgcagcgctgttaagatcgactcgtgatggtggttgatcgacactttcagaataatgcggctgtaatgaactgtgttgtaatgcgctgtttggtgatgagctagcttgcaaaggactatgttgcaaaggaaatcgctttatcgatattttgccattggtagttttagggaattcagccagataaataatggcatgtggctgcatatagtgagcaaagttgcgactgataaactggcgtatccgctcgcttaacgccttttgttccgctttatcagcctgagttttcacataacagagtaattttgtttccgctaccggaatgcgtggatcaatcacactgtttgtcgtcagtacaacctgttcgattccttcccattggccgatgatactttccaactgagtcggctcaatccgataaccgcgtaccttaatttgaaaatcggtacgcccgaggaatgacaaacacccctgttcatccatgctgaccaagtcaccggttttatacatgcgcggagttgcatgattacaagcttcaagcggaatatacggatcagtcacatatttggcggcggtcaggctgttattaccgtaataccctttggataccagcggaccgccaatatacagctcaccagactcgccacgcggcactggctgccgcgcttcatctagcacataaaaaccggtattcgccaatggtttgccgagcggcactgtttcacctacccatgtatcagaggtaattaccgaatccgtagcagtaatggtggtttcggtctgagcataagcattggagaaaatccctcctttcggaacgtgctgctgccattttttaagcgtctgtgggtcaactttttcagtcccgactaaaatgcgtcgtaagtgcgatggataatccatcgcaggatcgcccaaattctccacccatccttgccagtaggtagacggtaaatcagccagcgtaatctgttgctcaatcagcaattggttgaaatcagcgaaggtatttggcggtgtatcaccgaaaaagacaacccgaccgcccgcagtccagacagggaaaagttcttcaaggacaatatcccagcacaaatcggtaaattgaagcatccgatcttcggggcagatcgccagatattccttcatcatcaaacagtggtgggcgatggcaccatgagaattcatcacgcaattcgctttttgggtactgcctgaggtacaggtaatataagcggtctgccctgctggaataactttttcgggattttgcagtaacgccgtatttccctcatccactccacattgacgcaacagcgtttcttcatcgtaaaagttgaaatattgaacgtgagagagggttttaaagatgccataatccccgtcgataagggcaaatcgcggagtcagtattgagagcagatattcaacctgagctacagggagttttttatcgacaggaacatatacgccccccgatttcagtatggctaatacggagattgccaaaggaacgccacggcgcacactgacaaaaacaggctcttctggttgtaatccttggcgtaacaagtgatgggccaacgcattcgcctgatggttcaactcagcaaatgaaagttgcttcagcccttctggcaaactggtatcaactaatgcacatgcctgtggttcatcggctgcacgccgttcaaacagggtatggatcggtgcttggtacaaaaaatccttccgcactggcccaatggcaatggagggtgcgtccagtgagttcagataagtggcaatatcggccaaggtcagtgtatctagctctggggcattaaccaagtaactcaataattgccccattttgccggacagtattttaacttgtaccttgctgtaggcttgtactgcatactcccagtgcagatacaggtcattttcgctctggaatacatccaaagacaattgaccaataatgtagcgttttggattgtctaacaatagcgaccaactaccgctgtcattaagcctgagtttacgggggctaaaattgaaatcgtaattgagataacggttcagcatttccgaacgattgcccaagctgcaattttgcatcgtcagatcgtcaacggtcacatcctgatgggaaaggatctccaacaattgctcacaggtcaggtcaagatattcgctgaaaaactgctgttcgttacgggtattcacccgaacgggcaacatcgctgtcgttaatcccaccagattatcgaaattatcaaagttgcgcccggacaccgatgtggacataacgaactgagattgtttaagtaccgaacccagaaaaatggagtagacggtatacatcaacatgtaaggtgtcacgcgatgttcggtggcgtaatgcaaaagcttggccgtcaattcagccggtaatttctccagatggaagccccccgtagcaagcacgtcaccttcctcagtgagcacggcaggtaccggggctggtaaattagccaaatccgtctgccaaccagataaatatttatgccagaatgatttctgatgaataaagtctggtgtccttttgaatgcagccaaccgtcccagataatcttgatattgcaaaacgggtggcaagtcactggcaccatgataaacagctaccaactcgtcaatgaaaatatcaaaagagacgccatcgacaacagtatggtgggcaaccaaaagtatgatatccacccggcaatgatccgatgcgtattgtgccaaaggagtcccatcccataatggtcgggacagatcaatctgtaccacatgtactctgaacatcggcccacggtcgagtataaattcttcatccagacatgcttgttgccattgagaaaatttctctggtgaatcgaggggcgactgctcagcccgcattgcagcatgataatcaaattgtcccggtgccgtttcaaacgtttcagggcaaaatacctgtcgcagctgttggtgacgattgaatagatactcaatcgtgctgttcaaacgatggggctgcaattcatcggtaatcacacactgaatgaattcattgtaagattttgaggctgccggatcgtaccaactcgccatcgccagatttttctgcatcccgagttcagccaagaccactatttcctgcgttttcggggtagtcggtctatcctgcggacgaaaagaagaagagcgagaaggaactgagattccttcaacggttttctcgaaggcgttgaaacacgcctccagtacattatcatcatgagcggtagagaggaaacaagtgcgtccctcccacgtataaaccccattcatcaataaatgatggaagagcagttcgtgatttttcttctggctgaatttaaaaagtgatccaaaattcgcaacgtctatcccgctatttgctgccgtgaataaaccattaagccgtttaacgaaccctgtagttctgtcgttcaaatcagcttgtaacgatggtccttgtgctttcatatgtaacagcgtcgcttctgctgctgccatcgccaaaggatgtttacaaaacgttcctgcaaagaaggtggtttcattcggcgggtaagacgcgtcaccaaattgccagaaaccgccatcaatataatccatcactgcggcatccccagctaacacaccaacgggcaggccaccaccgatgactttgccataagtcaccaaatctgccttgacctgatagtaatgttgggcgcctcgggcgtgataacggaaccctgtaatgatctcgtcaaataacaatacgatattctgttgtgcggtgattttccgtaacgtcttaataaaagatttcggtcgtaaattaatattgcgtgattggacaggttcaaccatgaccatggcgatttcatgcccatgggtcgtaatgtaatccaagctttgctgttcgccataattaagcaccacaatatcctgtcccaaattgtcaggaataccgctggattgagaaaaccgctctccttgcttcatgccgcccataaaaaggatttccgtataatgaccgtgataggcattattaaagatgacaatcttttgtttcccgctggcagctctcgccacgcggcaggcaagcataatcgcctcagagcctgaattggtgaaagcgacccgttcaacgccggtgatttcagtgatgagatccgcaacaaccatcccggactcatcaacgggaccaagatgaaagccgtgctggagccgtttttgcaacgcttgttggataaagtcgggattatgaccaaaaaaattgacgccaaatcccatcgcgatatcgataaaaacattaccgtccagatcggtaaagtgtgccccttttgccgttttccccacaatcggataacacagttctttaagtttgctgttgaattggatcgcattgcggttatcacagagagctgtccgatatttctgaatagtggtttttgaagcgctggttttcgcgttgtattgttgaataaacgcggttgtttcggcatcacattgcacagattctgaaagcacaatcggtttgtaggtaaatttggctttttcacccgatgaagctgctggcctaatcaccataggctgaggctgttcagaatgattagtaggaacttcgacggattgtttggttgattgagcgctgtttagcggaaccgtatttgatgttgtaggtactgtggataatgctggggtcaatgctgacactggcaattgattcgctgttgcaaaattcgtggttcctcccctgacattctgcaataccgccaactgttgttggaacagttgctgcatagcgtttaactgagccaccataatgccctgtttagtatcaatatcgtgtttggtttcgcggacagtatcaataggtgcattagccataggtgtattaactataggctcgttgaacgccatcgcaataggcgacacagggggcgacaatgatgctaatggagatgttggtgaatctatcggctcacgctgcatattgacggtttcctgtggctgtacctgtgcttgtgattgttgtggcgttggcatctctggcacagatagcggcatctgcggcttatcattaacgctaccagccggagcaggttgggtctgctgactgacgaaattggcaaccttatcaatattcgacaatcccttaaaaaatttcccgataccgatatccaccccatattgggatttaatattgtttttaagtctaatcaatgtgagagactcaatacccagcgccagaaagtcagtatcggtaggcacatgctcactcgctaattccgactgtaaccaactttgcagagagtgtttaatttcatttggcagttgcgtcattacgttactttcccttcataagttctaattgggcttggaaaatggtgttcatacagtcaatttgctgctgcatgatgaagaaaggttcatgatcaatcaggttgccatgttcatattcatccggcttttcctgttgccttgcgccattcgctaatgtggcggtgtattccgtaaaccaacacgtttctgtcagtagttttctggccggcaataaggcgggattgaacgtgaatagtgaatacattgtcagccattctctcggcgagccggataaatggtcgctggccagtaccgccaataaatcgcaataattgagttgctggctgttttgggaggggcaataagcggaggcaaggtgatgcggttgtttttccatcaaccacgtgccgagcatacttttgggaccaatctcaatgatcttcagcccggtcatcgccgttaagttctccagattacgtcggaacaggacgcggcctaacatgtgctgctgccaatattctgctgtagcgaaacactctgtttccggttgccccgtcagattcgacaaaatcggcacttctgccgctttaagaggaatatcagcgaggaatgccccaaattcttgagccgcattgctcatcatcggagaatggaatgcccggttagtattgataaagcgggcatagaagccatgctgttccagttgttgccggaagcgctcaagcgcacaacgtgtgccactgatgatggtattagtttcactgttttctgctgcaatattcagttcagtttgctgtttaatctttagctcgttctcaatcagagcgctaacttgctctgctgtgccattcaccatcatcatcgcaccacggggatcgctggcttccatcaattgagcgcgtttgatgatgatcctcagcccttctttcagggaaaatacattcgcgatgcaggccgccacatattcaccaagactgtgaccaagcagaatatcaatacgcccgatggcgggacgcagacattgatagagcacatattcgaaggcaaacaaaataacctgagcaaactcggtacggttgatcgtctgttcgtctaccggctcaatcaaaagttgtttgacctccaccttgagttgcccactttcatatgctatctccgaacacaattgatcaatctgatcaatccactgggcaaattgcacattatgacgatacaactgtgccgccatcgctaccgattgagttccctgcccagcaaaaactaatgccatcgttgttttatcagtagttatagcagcaattgatgggccattttcactggcgcgataaccaatcacttctcctctgactattgcggataactgctcaaccaattgttcagcactatttacccccaatgtacagacaaccggtaataccgtacgttgagccagtgcttggcaaaagtgcctaagcacaaattgcttttgtgtcacatgttgttgcacatcggccaataatcggctggcaatagcctttaggtgtgcttgatcgcatccgctcaacacgcaaggtaatgtctcgttttctggttctgtatcagaaagtccttttttactttggcttttgatcactacatgcgcccctgttcctcccatgccaaatgcactgacggccagacacgttttttcaggggcgagcggttgtgcggtggtagggatcgccagttgcccttccgccaaagtgatccgtggattcaactcgctgaatgctgctactggcggcgccattctgtgtttatcaatcagcaaaagtttgatcaacccggcaataccggcggcagcttcgagatgcccgatgttggctttgatagcgcccagataacagggagtctgcgctttttggtcatgaaaacaggcatggatacccgccatttcgataggatcgcccagatgagtgccagtaccgtgagtttcgaaataaccgatatcgctcgccttcacgtctgcattcgcccaacactgttccagcaactgttgctgtgcaagcagatcgggggcagtgatgccattactgcgtccaccatgataaatttcggaagccagcaggcttgctttgacatcattgttgtcacgaatggcaagatcgtgacgtttgaggatcaccaccccggctccttcgcccagaacggttccgtttgccttggcatcaaaaggacggcatatcccatcatgggataacacgctcaattgctgcatttccctgaaatgggccatatccagttgtaggtgtacacccgctacaatggcggtatcacattcaccccgttcaatactcaaccgcgcttgatgcaatgccaccagtgatgatgaacacaaagtatcgaccgttaacgaaggccctcttaaatccaaaaaatacgataagcgattagcgcatacactattctgattgttgattgcgctgctcggatatccctcttcccctgtctccgtgagatactcctgtaacaattgccgataaccattctggctgatgccaacaaatacaccggttcggctttctttcaaaccattcaggctcaggttagcctgctcaatagcttcccatgtcaccatcaacaataatctgtgttggggatccatcagtcgggcatctttggggttaatttggaagaaactatgattgaactgacgaatatcgtcgcaaaatgccccgctcaactgaatgccgttagcctcaaactctgctaatagtggcgccataaaaggacgatcctcagggcagcggctgaactggctttttcctgccagcatattttcccacaactgatcgcaatcttctgcgccaggaaaacgtccggcatagccgataatcgccacatcagcattaccttgtttaggcggcagtgatgttgtgtcctcagtgcacaggtgactttcatctgtggcttgcactgctgatgtttgtactaccagtctctgccaaagctgatgaattgacgaaccggagaacaacacgacttctgtgacagtgtggccgatggcctgacttaaactggctgctaattggatgatggtcactgagttataacccagatccaataaagaacgttgtacatcatcctcggctagctcttggcctcgcacttggccaatgatgtgaacaaatgtttcccagttaatccgctgttttggcgcggtatcttcagaaacaaccgatgaaacaatatgattttccgtaattttcagaaatgaatgacatgccggatttagatggaaaggcttgctggtatcatataaggcatcacgcacaacctgataattttcgcgtacagtacgctgggacactttaaatgatggtgtgacttcacctttggcaagggacagtgaagtttcagtgaccgccaccgcaatcaatttaagcgaactctccgccacctgatgattatgctgttgtaccacctcaacaatatgctcctgcaagcgtgatgaatgttgtagtgtgcaattctcaccaaatcgctggcggcaaagctcaggattaataaacaataaagcggtagcgtagggacgttgttcaatatcaataatggcatggttgataatatcggttttctcaaacagactttgttcaatagcatcgctggacaccttttcgccattagacagttttttgaccgaatccaaccgtcccagaagcacaagttctcccttgaccatcttgccgagatcgcccgttctgaaccactcctgtttgaagcagcgacggttagccgcttcatctgcgtaatagcccaacatcacattcggcccttttgccaaaatctccccgctatcttcatcaatacagagagttacattgggtaaagggcggcctacgctgttgtgttcttcacagtctgaacctttaagtgtcaggcatggactggtttccgtcagtccccaaccctcagcaacgtagataccacaatgattaaaatagtcttcaatatctgcgggtagtttggaagcggcagagaagatcatctgcaatgtcggtgccactgcacgctgaaaatcctctgaatgtttcattttgttggcaaccactgtcagtatctttggcacactgaaaaatcgtgtcggttttaactgactcaaattggtacacagccgagcaatatccatgccccggctgttatcaatatgtaacattgcctgactgaaaatggccgtgtatttttcaaataatccaccaaaactgtggtgccacggcagataactgagaaaagattgcgggccatcgaaatgccataatgtttgcagagcctgttgctgtgaaagaatattactctggctgagcaacacgcctttcggtttgccactggaacccgaagtaaacatcaaacaaaatgcttgttctgcctgcgtggcctgcaaatctgtagtgagcgctctgagtaacgcttccccgacaacttcatgactgacggttttatctggactaatcaggtcggtttcgctgtcaatgctggcaaagtcagtgaaagtgctggaatgctccaatgtcatcacctgccacgaggtattctgcggcagcgtctgcgcgagtgataccctttcagtaataactaatacgggttctgccaatgacaggcagtaagtcatcacctcctcagaataatttgcatatatcggagcataaatagcacctttaagctgacaggcgaattcaatagccagtaattcccagcaattatgcgaaattgtcaccaccctctgaccacgagaaacgttcaattcatgcaagtaacgataaatacgcgcaacgctgcacagtaattggcaccagcttagctgacgcccagattgcaagtcgttaaaccgtattgcgtcaacatcactgagtgcttttttcagtaacgccaaaataagtacattatcagtatcaagtccctgaaggcagccgcgccattgatcgacaaaacgatctgctcctgcattttgcttttgtttacgcatactcttaagccaaataaaaaagatcactcaaatacatcacgatttcaggcagcaaaaactaacctctatacttaaatttaaggtaaaaatttaaggcaatacgttgatgcggccgggtaacgacaagtgtttaaaatcccgtaatcttgttaaaatttgggtacgcttcaaccagcggtcagtgccgtcatatctgggttggtacgctttgcggccatgagcacagcggtaattatcaataaaggcaatttcaccgggacttaagaccagatcaaataccgccgcttcagctaatgcttccaattcagacacagcctcaagttcttcggtatccaatgcatctttatccatatacagagggtcatagcgcatatgaatatgatcgccactgcccgtcaggatagagcaaacagtgtaattttcatgtcgttcttcttttgacaaacaaggacggtcgttaaaaatatggaatttgtttttcttgaggatagtgatggttttctcactgagtttggaaaaatcaggtactgacacgctggtcgggatttgataaatattgcgaatacacataaagccgaggtaatccgcacggtagtccagcgaggtatcttcagtatgcagtaatagatccacggagcctgtccctaactgctttccggcgtctttctggattggaaagatctcttgcaccagttttccgtcttgtaaatcagaaaaaccgactacgtcaccgcataagctagacatcaaacaacagtagtagtcataattactgttcgtattgtaaatattcttccaatggttcggtgttgcccccatcacctcggacatatcgggatatccctttattacaactaatggataaccttgatggcggaattttttgacttcgatacgtaatcgggttggtaatgactctacccactctggcaagctgcgaacaaatgcttgatcgtcagttgaatggtaacgttcttgtaagctcccgatgagtacctgaatatcatcaacttctgaatttgacaattcaatggaatatatcgattggttcattattgttaatccttatggtcatcaattaccgcaatacgtttgcgatccgttcaaatccctgctcaatagcatccattgacgcagcaaaagaaattcgtacatgtccacgataaagacaggcttctgccgggatcagggctacccctgcatgggtgagcagatattcacagaattgagtggcatcacgacaacggtcattgaggtatttttcaacattggggaacaggtaaaatgcgccagcaggaagctcacattcgaaaaattcgcgggcatattggtatgatcgatcacgtcgttttttgagtatctctaacctttcttgatacaaatccttgggcttttcaagtgaggcaatcgcaccatactgggcaaaagtgcagacattatcggtcatatgaccatgcaggtcagagactctgcagattaattcaggatgggctatcatatagccaatacggtagcccgtcatggcaaagctttttgaaaatgtttgcaccgtaataatgtattcattgtcatcaatggcagccaagctatgatgttcatcatcaaatacaatttgttcataggcttcatcagataacacgaatatttgtttttctttgacgatttggcacagtgtctgtaatgcggattttgagtaaacggctccggtcggattattcggcgtattgataatgataagtttggtattgtcagtgatagcctgtttgattttttcaacatccaaatcaacaccaatattttcaattaaaaccgctttccctccggctaatttgacagcttcaagatatgtcgcccaacagggtacgggaataatcacttcatcgccggggttaatgactgtctgtaatatttcataaataacttgtttggagccattggtcacgatgacattttcaggcgtcgctttaatccggttatcttcaaatactttttggcagatcttctctcttaattcaggttcaccgttgagccagctataacgagttctgccatctatcaatgcccgaagggtttcattaacaatagtggcgccagtactgaaatccagctcaccttcattcaacccaataatgtcacggccttcacttttcaatttggcaacgatatctgccagccctactgccactgaggcattaatgttctttgccctgttagcaatgcgggatgagaaaggattctcttgtatcatcatgaatatccctgttaattaatatagcaatgcttaatcgttcgttttaaaaagctatcgtgttaaaaatcgatagttatgggagccgaaagttgtaaagatcgctatttttataaatcgatcgtcttagagagaataatttcactattacggtgttcagcggaataattattcaaatctgaaggcggcttgatatattcagtaatatctaaagagtcctgtttataattcttcgccgtaacacgaccatcttcatgagtggtgacatgtgcccggttaacagacaatttgcctaatgttgtcgtaacgacatactgcggtacactaaaacctgtctcgaaccctaccatcgcatccataatttcctgccccttctccagagtggtcataaagtgagagacacctgatacgttatcacaatggtacaaataataaggacgtaccctgattctcaagagcgccttaagtagtgaccgcatcgttgctacatcatcgttgatcccttttaataaaacggactggttttgcacagggataccatgccgcagtaatcgatcacaggcagcggctgcttcttcagtcacttctttagggtgattaaaatgcgtgttaacccagatgggatggtacttttccaacatctgacagaacttttctgtcactctctgaggggcgaatacgggataacgggttccgatacgaatgatattaatgtggctgatgcttctcagtctcttaataatcgtttcaagaaacttgtcataatgtattaagggatcgcctcccgtcagcagaacatcatcaatttcgggatggttctcgatataagcgaagtcttcttcataagatgcgacaagatccgaaccaaaataggtgccactgacatccgttgtgtgaaactttcgcgtacaatggcggcaatagacagggcaagtatccgaaaccagcaaaacaattctattcggatatttatgcaccactctggctgtcttgaggtttgctgtatctcctaccggatcattatcagagttttccgctacgttcatttctcttaaatgaggaatagtttgtaatcgaattggacaattctcatcatgtttgtccataagcgaggcataatacggggtactctgccacagatattttcctttaacggcttctatggctttcctttctccgtcagttaacgcaacccatttttccagtccctcagatgttttaattaagttacgtaactgaaacttgggatcgttccactcctcatcactgaacgattctttacttaagaacataccatcttcctcatatgcttttggattctctattaagtgtgagtcatgcttcaaaccacgacagtaaaatttaaaaacaggcgtaataaaatagctctcgtatcgacaaccaaagggataactcacggaaaaatgtgggtatataatactgagtgttttggtaacgtctggatagcactcattaataacaacagggtttaatataaataaaccctgaaaaattgcagactttaaaatatatctcccccttaaaaataaataatacttttaaaaacaaatactccattgaaaacaaatacgttatttaaaagcaaataccctacataaaaataaaccattatttcaggtcacgtattcaatttattgttcctcgtgtatagcccatattttttgtagggagtttaaatggcgacggtagaagtaaaatgtcgattttgtcaacaaacagagtcggtgagaaaacatggctccgatcaaggtgaacatccaggataccataaaaatctgtggggcactttgttaaataggcgataaaatgagcaattaagcacgcttttatccggcatctcaccatgaaaacctacgttgcgaaagtggcccttcgggggatcagtcctatgatctggcaccgattcagactatcaggcgaaacttctttagccgcttttcactatatcattcagatcgctcaggggtggcaggatgatcaccttcaccaattccgtatttatggcaaaaattacagcatttcctactccgacgggattaggtttcctgataaccctgacaaaattacgctggatgattttgaatttgatgccggtgacctttttacctatgagtataacttttttgagcactggcttcacgacaggttctgttgcattaaggcatcgtcgggtaacatgctgttttttttatggtgttacctgtccatatcattgatccgaaaagccttccgtcgcctgcattatcccaccgatgttatcgctcagtgtgttcggtggtacctcgcttatgccctgagtctgcgcaatctcgaggagatgatggctgagcatggtgttatcgttgacattccacgcttcaccgttggttcatccgtctggtgccattgctggataaggcatttcgccggcataaacggtcggtaggccgccgctgcgttgcgcttctttcgcaaggccatccgtcaccacagcgaacctgaaagggtgatgatcgataaaagcggcgccaatactgcggctctggccacgctcaatgccgacaaacctgaagaggaaaacatcaccctcaggcaaagcaagtatctgaataacctggttgagcaagatcaccgtagtatcaatcgtcggatacgacagatgctggggttcaaatcgtttcgccgggcacagacgctcctggccggcatcgaactgattcacatgatacgcaaagggcaatatcaacatccacaaagtgatggattatcacccgcggaacaattctatttgctggctgcctaaataaccggcaacaccacttttgctaacttgccgccgttaacgcgacactgcccttctgaaagtgctgctgtcgtaacctttgtcagcgatcacaaaatccgatgaaggcgaatgcgtcacccaactttccgcatgaacaatgtcgtgagtttgaccaccggacagctcaaaatggacaggtaggccataactgtctacggctaaatgaattttggtagaaagtcctccccgacttttacccatggcttcatcttccacagaagcggcacctgaactatgttgatgagcccgaacaatactgccatcaatgaacaaccattctgtatctgtattctcagataataatttgaataataaattaaaaatagctttcttagacccatcattaaagcgcttaaaaatggtgttccatttgccaaattcagtggggacatctcgccagggacagcctgttcgcatccggtaaaggatcccttcgaaagtcagataatgttcttctttgtgatacacatatccactttgttgcatcaatacagctagcttattccataaagattttgataacattgttcttggcatgatggtctggggtaatggttttttcgcgaagacaatgataccagatcatcatgctgttcaaattcccctcataaaacgtcaacagcccctagtgactttgggctatactgggctgatttttacgctttatggtaaccccgtgagatatgcaacagaatttacacagcgcgatcaactgtaaaaaatactcattggtagctattcgctgtgagttcaacgggtcgatgcaacacactggtaaaatcgctctgcgggtgactcatagcctagcgtttttctcggtctctcgttgagttgcctggcaacactatttaatctttgctggctgtgaactgataagtcagttccttttggaaaatactgtctgagtaacctgttcgtattttcattggagccacgttgccagggagattgaggatcacaaaaatagacctgaatgtcagtggctacagtaaacagggtgtggttggtcatttcagctcccctgtcccaggttaatgttttatacagttcaacaggtaatttttgggcttgtttgatgagtgcagatattactgtcgtggtcttgttgtcactgattttagccagcataacaaagcgggaatggcgttctaccagtgtgacaatatatgagtttttagagccttgtatcaagtctccttcccagtgaccgggtatggccctgtctgcaacattgggtggcctttcgctgatgggtatcgcatctgggattgtccctaatcctttccctttcagcgatgttgttctggatttgcgcactgttcttctgcttctgaggcactgttgcagccctttttttaatgctccccgggtttgtataaaaaacgttttataaatcgtttcgtgtgacacatacatttcctgattatcgggataacagcgtttcaaccaaccggcgatttgttctggcgtgtagtaaatgcgcgttcttcgattcatggcaacatcctcctcgtttaaggatagcgttgcatcgacccgttgaactcatagcgaaaagcagacttcggcgtcagcaagattacgttaagttggcaaagctatatgatacaattttatcatgctgaatcgatggctaatccagtagggtagtactgagcatgcgttacgttactattaagagtgagacagtagattgaaaacaaaacagtcaaaaatccccaaatcaatttataggcccatgcattgcgacgagtttgacctctgggcgaacctctcttcaaatgactatgttgaagacctgatgacaaatcatcggtacagccgtaaaaaagccgaggtagaggcgtcgaaatcatttaaaacagccttgccggcgggtatcaatactcaaaataaccattttagaacttatgaacatgacgctcaggctgcgggatatctgtggttcagcttggaagataactcagcttttttgtcagatataatgcttatcccagaatttcagggtaaggggatgggcagggattttatccgtgcgttcctgaatgaactgactcgccagggtgcgtatgaggtagaactaagagtgtcaccggacaatcaaagggctttaaaattatataaagagtttggttttcggataactggttttgatatgagtcttttgctggaacccgagttatcagcaatccgttaatcataaggttctgtcgcattaacagagaaagtttgtgctgaggtgggaatgatgactctttatgtagttaatcgataaaacagttctgccggtgacaatgtcttatcttcgggttgtgagtattgccctttacgccgcatcgaaacgcgctctatccccgctaaaatcgtttgggtccggcgaaacgatttaaaacctaacatgggtcgtatccgacgtttgatattccgatgatcttgctcaatgcggttattgagaaacttatcctggcggatttttatggcctcttcctttgatttatcggtattcagcaaggcgatagcggcggtgttggccccactcttatcgagggtgatgatgtcaggctccccgtgttgccgtagggctttacggaagaaacgcaaggcggctgcggtatctcgtttgtcggtcaataaaaaatcaatcgttttaccggccgtatcgaccgcccggtaaaggtatttccactgacctttgattttgatgtcggtttcatccatgcgccagcgacgccccacaggacgtttatgccgacgaaaagccttactcagcaatggtgggtcatgactccaaagcgttaacctgatattcttatgcctttttaaggggatctcaaaatgacggtgacgatagaagttgcttgccggtattgtaaccaaaccgaaccggtacgcaaacatggagcaggtaaagccgggtttcctcgttattattgcaagggttgccaaaaaaccttccaactcaactctcgttacaatgaccataagccgggtatgaaagaaaaaattgtcgatatggcgatgaatggctccggtgtgagagacacgggacgtgttttaagtatcggtatcaatacggtaatgcgtactttaaaaaactgtcgccaaaacaggtaacatcaaggcaggttgtttatgatgatgtcaccctcatttgtgaactggatgaacaggggtcttttgtgggcaacaaaaaacaacgtcattggctttggtatgcttttgatacaaaaaggaagcaggccatagcccatgtattcggtcctcgaacagatgccacctgcagaaaactgctcgacttattagccccttttcatattcgtttcatcacgaccgatggttggggaagttacgccagagaagtcgagccagaaaagcatttggtgggaaaaattttgacccaacgtatcgaacggcataatctcaacctgcgcatccatatcaagcggctggcaagaagaaccctttgttattcacgctcaatagaaatccacgaaaaactcattgggacatatattgaaaaatatcattataacgcttgggagtcatgacccaatggtgttaggggtattgtgcccaattcagcgaaaagtttcacgaatgaaaataaatttattaaattcaattcattatgattaaattcattctattaatttaatctcttttgatactttagatattgtgtgtctagaacaaccgagcaagtcaacaatatagctatagcttttgtgttccctgagaagaccttcgattttttggtgcagtttcttgtctatcgggcggcctttatacttaccttcctgcttgtctttctttaccccctgagcctgatgacgccgcctgtcttcgtaatcttttctggcaactgctgcaagcatatcaagcatcatattgttgagtgctgtgggcatacgttcagtgaattcgtctgtattcttcatgaactggtaactggttgggagatctaaagaaactaccttcagccccttatgattaatcatatattttaacttttcccagtcagctgtattcagccggctaagacggtcaacttgctcaactaagataacatcgcccggcatgacaacatcaagtaaacggaagagttctgtgcgatggagacgagcacccgattcattttcttcaaaccagcaagcaattttgactccctgcccctttgtaaactcaagcagttcgctttttgctctggatgcatcctgttcatcggttgatgctctcaggtatccgtagatccgcatatgggttttcatcagtgcactatacatggtgtcattattttggtgcattatacattgttttgagctattttctgcaccgcatttcgccagtgtattaagagttaacttaaattgtactactcgtatcgattgagtcatcttctcattatattatgtcgcctatttttagctgatatagcataagaacaatgaaaaaaatcaaatcaagtcgtattcaaattttgacagagcaggaaattcatgagctgtattctcgccccacttttaatcaagcacagcgcgaagaattcttttagttagatcctagcatcaaaaaatttctatcaaaaatgggaaagatagaaacgagaatatatttaattcccctgatcggttatttccgcgctaaaccagtcgtacctaaatttaaactacgagaggtcaagcaagatgtagactacatctacgccacttatttcccaaacagagctcccaaatatccatttgtcgctaaaagtactcgagcaacattgattgtgaagatgtatgagatattgggatttgcaaggttattaaagcgcgatagacaaacattaatggatcgtttaaaagacgtagcaacaatctgcacgtatccaaaatatatttttgatgaatgtctggctttttttgggcaaaaacgaattgggctggttggaagtggagcataattatgaaaacttatttataatgctggagaatgtttctgacagaaatggcatttatattcaattagttaaaaaaactcttcccaaatagaacattagagacaccgtagtccgataagtttcctattgaaaccaaatcgcaactacgtgtctctgaattagctattcttaaacaattcgaaggttgttcctacttcgtaattgccttaacttgcaatcgatatgtaatcaatgatgcaagttcagccagcggcttatcacttaacaacaattccagcggaatatccaaacgtaattgtttgttgattttttgtaccaatattaaaccattcaatgaatcaataccgttgttagtcaaaggtagatcgggatggaatacttctgttgacgtcccaacaatctcactacaaaaggtttgtagcaagctaacgacatcgtccagatcactcactgcaagcgccgcttctatgggtaaagtctgaaccacattttcttgctgaatatcacgcaatagcggtaggtgacgcatctggctggacagcaaatttgaccaattcgtcaagaatggcaccagttgcggctcaatccgagcaaacaagcgctctaaaacagctaatccctcctctgaaccaaatggctgtaagccactattttccaatattggcagcgttcgactatcccgcaaagagatccccgcttcccatggcccccaattaaggcttaacgcaggtaaaccttgctgacgccgtaaacaggccagactatccaacatagcgttagccgctgcgtaagatgccatacccggtaaagccaataatgcccccaacgaggaaaacataacaaaatgctctaaaggtgcatcagccaacgcttgatgcaatgtccaggcagctaatgctttagtggcaaatactctatcaaacgcctcggggctgagttcacgatatccctgatcttcaacatgcgcagcgcaatgaatcaccccacgcagcggctggctggcttgttgtcgatactcagccaaacaaatgtgggtcctttccacatcaccgagatcaaccggcagataattagcctcgatcccttgttgatgcagcatttccaataacttttgatccgccgtatcaagggcaagacgacgcccgatcaataacaaatgttgagcaccatgctgtaccatccaggggatcaattgacgccccatatcaccaaaagcaccagtcagcagatagcagccatctggacgaaaacgcactggtggtagcgcgggtatttcaggtaatggcacaaggcgtagcacataacgctgatcatggcgcagagctaattgatcctcgccatcacctatcaatagcgcgtcccaccatttggctggagccgtgatactgtcaatatccagtaatccaccccataatgcagttgcttcttgttgaccaataacgcgcatcattccccataatgcggcggcaaatggatcgggctgatcctgctcagtgatttgatgagcacattgagtcactatccacaaacgtggttttatcgaccgttcggccagcgccgcacacaaatggatcaacgaatgataagccatccgcggagcctgcaacggccagaggatcaggatcctttcggtttcaacaggaagagtatcaactaattcttgaattttctgataactgtcaggcagaccagaatacaacgaggcacacccaccacggcgttgcaactcatcaactaactcttctgccagagcgttttcacccccaaggatagcccattgcgtcacagactctgttgatggctgagcgggcagtttacgccactgtggttggccgacaaccagattgtgcagtttggcagacaagctgttttttctattacccacaagctgaacgcaaaacccgctgatctgacaaagcaacataccgctatcagtatagacgtcaatatcaccaagccattgttgttgcgtctgcttagtatttcgggcatgggcatgaacccgacctgacaatttaccattgatacgcaaatgctgaatactgaccgggatacggaactcgttggcaggaattggcgcgtgaacatcagcagactgaatcgccaacaatgattggaagatgccatccaaagccgctgggtgaaaattcattccctccggtgcaggtggtaattcaatctcacagattgtttcttctttaccaacaaacgcatggcgcagagtacaaaaaacaccactataactgaaatgtagatgttgaaatgcctgatacaacatctcttggttccacatgcaaggatagcgatcatttaccgctaatggaggaatagcacaagcagtagcacccggtacaacgatgttcacctgtgcactggctgcaagttggtaatgtacactctcatccagattacgggtaatgtgtacttgcacttccattcgctggcgatctagctgtgtctttaacctgaattctatgcctggctctagcagtaaagccgattgcaacacaatattatcaagcgctaatccaacgtcaggaaaacagatacgagccgccgccaacatgatttcaatatagcccgccgccggaaacattgcatttcccatgacaacatgatcgagtaaccaaggcacttgttctacagccaactcagcttgccaactctcgctgcccggctgagcttcgcccaataatacaccgctcaatatacgtaatcggcggcgacggctaatctctggttcataccaataagattgctgatgccaggagtaagtgggtagatcaattgggcaagcggtaggcatcagagtctgccagtccggttcaaccccagcttcaaacagctgtcctaacagttgtggccagttctgccctgagcgacaagcaaacacctgtcctcgataaggctggctccaatcctttaatcctgcactcagtagggatttaggtgaaacttccagaaaatggtggaaacccgctttgagcatgttttctaccgcatcgtcaaaacggaatgacgagacgacattgtcagcccaatgctcgggactcaactttccattaatcaactccccggtgactgatgaaaacactggcaacaaaggttctgccgcgggaacggttgccgcatccgcagtcaacccagccctgattgactctatataatgggaatgagaagcaattctataattgagccaactactggcgatacgctgctgctttaagcgctcagcaacagcggttaattcacttataggcccagacagtaagcaacgattgatactattacgccctgctatcactacggcaggctcggcaccgggggcagacaaatgaggcaatatctgctcaactgtcgccgccacgattaataatccgccgcctttattcaacacacgttccagataatggtaacgctgatgtaacagtgtcagtgcctgcgtcagatcataaattcccgccagataacaagccgccgtttcaccggaactatgaccaagtaacgccgctggtttgaacccccacttctgcaactgcgcagccattgatatttgtacagcaaactgcattggcggctctatcagttcatcggcagagatcaatgccgcatataaggaaggtgcagaaaatcccgtccaaattgcctcacaacgctcgaattgttcagtaaattcgggaaattgctgaaaccaagcgatagagtcttgccaatcttcactgccaatacccgcaaatatccaagccagacgatcaacttttttattattatgctccgacgacacattcagattagtcaaccgctgtcgcaactgttctcggttactgaatgcgatccccttacgtaacggaaagcagtgacgagtcgtcgccaagctatagcacaaatcatcaagggcaatatctggctgctgttgcagcaaatcagcaatgctctgcgcttgttgcttcagagaaaactcagactgcgcagacaatggcagcatgaaagcttgcccttgcgtcgtccgaagttgtacggaagattctgcattattacttaacaccacatggacattcgttccgccaaaaccaaaggaattcaccccagctatcatttttccttcagacaatggagttaactgctgtggaacttgcaatcccaactcagtaaaacgaatgtagcggttaggcggctcggcatgtaaattgcccggtacctgtcctcgttgtaaacacaataccgctttaattaatccagcaatgcccgccgcagcttccgtatgaccaattacggatttacatgcaccaatcaacaatgggcggtctgtcggttcgggccgacagaccagccccagtgcttctgcttctatcggatcacctaccccagtcccagtaccatgggcctcaatataatcaatctcttccggggaaatccccgcctgagcacaggccatccgaatcactcgttgttgtgcggtgctacttggctgagtaatcgtgggagtgcggccatcttgattggcagctgaaccgtggatcaccgccaaaacgggatcgccatcctgtaaagccgcattcaaaggtttcagcaaaacagcaccgactccttcactacgcacataaccatcagcgttagctgaaaagctatgacagcggttggtcaatgatagaaaaccagtacagctttctactaccgaaaaatcaggcatcaacattaactggctgccacccgctagcgccagttgtgattctccgcgccgcaaactttcacaagccaaatggaccgctaacagggacgatgaacaggcgctatcaatagtcaaggatggtccttgaaaatcaaacgcatgggatatccggtttgacaacatggttcccattgcaccggttgaggtataaccggtagtctgacgcaaatcagtaaattgcaggtgcatataatcatgagtgaaagcaccgatatagacaccaaccgcctgacccgccaacgattttggcgctattctcgcccgttccagcgtttcccatgtcacctgcaacatcaaacgatgctgtggatcgataaaaggcgcttctgtattactgatatcaaacaccgccgcatcgaagccggtaacatcagcgataaatccgccttctcgcgccaccattttccccggcaaattgcgatctcgggaactataagcctgagttgaccagcgttcaggggggactggggtaattgcgtcacttgaaccacacaacagctgccagaattcctctggagagctaacaccccccgggaaacggcaactcataccgataatggcaatcggcatattatcgcttctcatcatattaatatccatagtggtattctttactccgattagttgtttgccagagcatcgtgcttacttatcaacaccaagtcgtcggactgggaatacattttggcggatgaggtggtaatcccggcgtcatcaatgactgatagctgatacccgtattgagtaactgataacgcaaaccacttgggcaggtggtggctccatccattgcctgagtgatatcaattgtcaccccaaaagcgacattaaccggttgcaatgtattgtcagccgcagtacggatgatacgtaatggcgatccaccacaaacttgcagatggttattaccgacctcactcacccgaatcaccataaagttacaatatcctcgataattcagatcggtgtctggcggctggttggagataatccaatattgatcactttgcttttcaatgattttggcattagataacagactgtagccgttatcagtgaatacctgacacaactcttttgagactgtgccactatttaatgaactcatcagctcaagcgccgcactgaataaaggcacacctgttaacttattgcctgtttcctcaaacggtaaagccaccgcgccattggtcagattagcgccggtcaatttagcttccgtaaagatagtgccttgaattgaagcaaaggccagagatgccagcttaagaccttcggtgggttctaacattgccttgctgaaatcagtattcaccagactagcataggacaaattcgcaccaaacaatcgagcctgagtgaaattcattgtcgctaagttagcattcgacaaattgacctgttccaaattggcgttatcggctctggcgttactgccgtaccaatgagcgccagacatatcaaccgcgtacagattagcgccagtcaggatagcattaggcataaatgtgttggcaagaattgccgcattaccgccattatcttgcgcaacgtttaattgcccatcctgatagtgaataaataacggtttaccatcatgttccaccagccagttctggcccggctgacgaaccaacacctctgcctgaccattaaccaatatctttccctgatacaacatttgacgtaaccgttcaggcagttgctgattatccagcgtctgagcatcggcttcatccaaatgtgtcactgtggataaagcaccaaattgagcgccagttaaattaacattctccagactcgcattagataaattcgcgccaactaaagagacattccccagaacagtggcaccggccagattagcaccgaccagaactgcgccattcagtgacgtagaatccagatttgcctttttcatcgacgccatcaggaatatgacttgatccagcttctggctgctcagattaacaccatccatctgtgcctgagtaaaatccgttttagcggtaatcgtggcatcaaccaagttcatctctgtcagcaccgtcgctaataaggtactgtcgctgaggttaagttgactataaccggtggttaacgataaccgtgcgttggtcagatttgcgccactgaaattaacatgattgatattcgccccggtaaaatcagtccccactaacgtggcttgactaaaattcgaggtctgcaaagtggtattctgcaaattcaccaacgtcatgatcgccgcggtaaaattgcaggaagccagactggcgccgcttagatcaacattaatcagattcgcctgagataaatcagcattctccattatcaccgaaggtaacaacgctccagagaaatccgcaccgggcgcttttagacgattcaatatcggctgaccaccactgctcttacagccacggaaaatggcgttcggtagctcagcgtcaggcatattggtatcactaccgacgatacacttttcaaaaagcacatttttaccatgaatatgcgttagatcagtcttgcttaagtcacaaccactaaaattacaatcatcaactttgacattagttaaagtagcgtcaatcaatgtcgaaccatgcaggtcggcattggacaaatcgacggccatcatcaccatttcattcaaattctcttcggcgagataagcaaaacgcagatcggatcccattgccccccattctttaaggaattccaggtcctttgtcacgatagtacgagtaaattgggctgacaggggcggactgctagtggctgcctgccaaaccagcccagattgttgcgccaccaaatagctgtcaccactgctactgatacgacacaagcgaaatccagatcccatcttttccaaccggatctcggcaaccgcgccattgcgcgattgattagcttgaggagtattaccgctcgcggccaagtattgaccattgcccgcctgtaaccaaaagctactaatgccataagcattaatcatttgatttatcgcccctgattgcttggctgaaaggctgagcgtaccatccgtctgaacagtaatcagttggccggaagttgctgcaaattgccatttaccggcaaaagatctggattcactcatgtcattatcctcttgattgaactacagaaacctttccggctctcccggcctgaccaccactggcgctaataccgccaatgccatatcccccatcgggtgcatgtgaaccatcaccatttacacccccgcgcccagcaatccccccagcgccacctggctgtccgacgccgccatccccgccatcagaggtggcagatattggtttcggtaagctagtctggatgtatctgacccaaacattaccgccatcgctgccagccccgccactgccgccatttccaccattgccaccgttaccgccgataccacccggcttccctgacgataatgaactaccacggccaccattaccgccatcaccaccattgccgccataacccgctgtaccgccattaccgccattaccgccactattgctaatacgcaccacgctctgtacgtcaaaacgattacaacgcagggcaaaccaccagctagaacctgattgaccatccaggccattctgaccgggttgaccatcaccaccagggccaccggcagtgggtggcttgcgtcgagagccattctgaccatcaatcccccgttgaccatcagcgccattggctccatcggcaccattcacgccattagtacccaaaatttgaatatctgcgaccatgactcctccttgccgttattgttttttgccgttgacataaactgagcctacggtacctgcttttccggcagttcctgtgctccccgatgtaccatttttacctgagctaccactggaataaccactaccgccgccgccgccgacaccaccagaaccaccattgccaccattaccaccattgccggcaattgccctggccttaaaggatgcgctccccccttcgttgtaagtaaaatagatgttaccgccgttacccgcgttaccaccattaccgctggcaccaccattgccaccactaccgccattaccgccgtttccagccctacattcgctggtagagccaccgccattccctccttttccgccatgaccaccgttaccaccattaccgccattaccaccattaccgccttgtgtcagcatattcacaaagcctgtgatggtaccggttttaaaattgacatcctctgcattccctcctttctcgccgtcacttcctctggcgccatcagtaccaccgccacccgcagtacctgacgtagcctgcgttgcacaggagtttttattatctttaccggggttaccattactgccgtctttcccattggagccactgtttccgctcccgccattgcctccgttccctccaacattttcaatgttcgagccatcattatctgtacctaaggtattaactatgatcacttcgttcgcctgaatcgtgccattggtgagataaataactttaccgccaggttgaatcgttatcttattaaaatttaagttaacaggttctccgtgactctctttactgccaataatcaatggattactggcagtaacaacgatatcttcaccactgtataacgcgactttcatcgggaaacgtttagcgttcagaatatcttcataatctttgaccaaaggagaataaccatagatataagcgcggaaagctttacatatatcagcatgattaccggtgacatttgccaaccgttcagcagaatagggttcaggtagcggatgatggggttccattccgcctggtccatactcactgtcaggcacacccccaagttccttcaattcttgtatggtttgtacggtaaaaaacgcgggtggcacagtggctattttcgggtcgttagaaaatatcaccggcccgtcaaagtccgaagtgttcaattgctttggctgccgctcggtaccggtcaaatgataatgctcacgcaattcagccaaagtttcgttaaccgttttcattttattcatgggaattctcctgagttttggtataagtttgtacgtttagaatcacagaggcgtcacatatcagttgcccaccttgcttaagcgccaaagtgtcaaccaccaccactatcggtcttgaagtcggattgctaatgttcagaaccccgtcatcagcaatctccagttcagcaatcgcaaaaacatcaacggttgccggaaaggatatcggcgcttcaacaggggggataccagaaagggtcaatagctccgatgctgacgacacttctgccgtataagaaggagcgagtgactgtgggtcgtcaggccgtaaagagccttgcgacgaagatgcaacaacgactttctccgttacatcgctctctgggatacctaataattgcaaaacctctttaaatcctgagctataattttttaatggcatagttgtctccgagaaactgtaaacagaaataatctgctgattatcgccatccacggtgcaaataactgggtaacgggtactaacatcagtaatgatgaaataaccattttcattgatagtttcgatcgttgccttgttactcagagggtgtttgttgtcagcaaaaactgcgcggattttatccatatcgtgttgctggaatatcggtaattgatcgatacccagatcgaatattggtgtagttggcatccactggctgatctgtggttgggtacgttgattttcacccaagaatttgccgtaattcatcgccaccagagtacggaacgaatctatcgccagatgtccagcaacaatatgctggcgtttagctggatcaggcactaatgtcgaatcagggacagttaccagaaaagtaccgtcaggattatagatatcaaggatataatccgttggatcccgcccttcgttacggtatgacaagacataaatatatcccttcgcctcaaccgcaacatccagatacgtaatcccggctggcttattcagtggcatataggacagataatccgttaccgtaatttgagcaggattcgttgcattaagggttaacagccaggatcgagcgctgctaagatcatcaatttgccatttggcaccttgaccgatagcgataacccgtacatgactcaaatcgttatatacagatacggtttgtccctgagcggtcagcgtataagtcgcggttttctgcggatcatataccaaccaactctgcccttgctgtatcacgtcaaccgttgtgctgccaactgggtcaatattaccgtctgcggtctggttataacttagatagatcccatcttgcgcaaaggtggcaataatctgctcgtccagtactccagcattcagcgaacgtataaagtttggatcactgttactgaacaggaatgtcaacccctgctcacgaaatgcttgttgtaatgccggggaaaactcctgagcatccagtgttgcctgataatcagcggtagcaagttgaaacagtgttgcacccgcaaaactcgggaatgggttccctttagtatcaaacgcctgaatacgggtattgattgtctccaataatagtatgcggccatctggcgttacggtcagggcaattggcccatgggttagcccttgccgaatcccttctccagagacaatctgtgccgctggagcctgatcatccggatagccctgatcacccaacgccaggatctgcatcttgctatattgccaactgacagcaatgacatagccgctcgggtgaaccaccatcgcatcaagatgtggaatggtgaaagtcccccacgaaagcggattatccgtcaaaccaaaattatggctgccatcacgcaggtccacccgacgtaagtgatattcaccaaaccgtgaatcaataataaagttataaggcgtgatggttttttcgtccggtccttcgccaaaactgttataactgatcagtggttgtactttgaaacctaccgcagataatttcagacgctcattcaacgagtcgttgctcaaagtggaaatgttttgcaacacgtacatctggccgctattgggtggacttaatggatcttccagtggaatatcctgaccagaagcctgatagcaataaccaacctgataatctgaattcaggattgtcatattgaccagcttgcagatgttattgcctacattgctacaattggttgaagactgggtttccaacggcacgctgccttcaatccactggtactcttttttaccgctatcgtaagacaactgttcccaatattcgtattgagtcacctgagtcagcggcaccaacatctcttttatattaccgctgacgcgcatgatgccttcattagggtcgtctggctgcgcattcagcagatcactggtgtagctccccgctaaccagccagtggctgaatagacattagccttgattttgagtgttccaccccagccaaccgaattgaaattaaaagatagtggtgtattggaacctgtcgcgggtaatggaatagtctgggtatagtaggtgccgttggtatattcaacggtcacctggcactgtactgccaccggcggccagattgcggtttccggacggcccgcttcaccatgagcaggatcaggatgcagagtaaaagcaagtgtcatctgacgcttgatatccacttccaatgtggcgggcgaggaaagtaattcacccgtggttacagcgatctgtgccacatccagcgcaatcgcagctagccggaacgcccaaccaaccaccggaaccgcctgcgcagccgcactggctgctacctgggctgtaacataagtcgctaacgcttccatcccttttttagccagaataccaatggcaatactggctaaactggttagcacctttttagtattgaataacgctgaaccgacagcggcgccaccgccaatcagtgggaaagcaataccggccagtatggcaacgttatccttattagaaataaaatctttataccactggctgttagttaccatggccccagctaacatcatcagggccggaataccgtattggaacataccggtcaaaatcacacccggccaaacaatcgggttctcccaacgggaggttcccaggccgccaaacaagaatttagctgcctgggcttcagccggccagggcaagccaaagttagtgggatccgtgggcatcgggatccccatgatcgtattgacattagccaatacacccagggccttttgtgatggcgtttcgaataacgcagccagctcttgagggaaataaaacggccaatcaccgtcaacctttggattatcgatcggctgttccatcttagtgtctttaaagaactgaatatagacacctagctgacgtaagtatttgttcttaaaatcaatggaaaaatggcttaggctgctatcgtaacggatgctatcggcatacacatccataccgtgattaggagtacggttggtggcagtccaaatttggttggtgtcccgcttaacagccaatgctgctgcctgatctttgaattcggcaacgtccagagacgcactttggctgacactccaattatgattttgcaggcgaccatcattatgcgaagttttcagcgcattagatgctggcgagccagaataattctccgtttcatccgataggttatattgcatcaccggatcaccttcggcgaaaatcacctgtccgtcttgacctacccagtcaaattcgtaaaacattgcgctgccatcagggtcaaccaattggccataagtggcaaaaccgcctgtctctgtcgcgggtccctgactcgatattgatatagccagttcataaactcggttatattgcagtgggtctattgcctccggtggggcaatatgtgcattcatgacaattgatgctgcataagcctgactgttagacaattccggatgggaaaacacaatagagcaagcaacatcccacggtgttttcatttcattagtcgcaacccacaaatcgccgcaatgaatagaatttcgcgctaaatgttggctattaacaccgagagcactaagtttacccggcaaagccatctctatattatttactgccagtttttctctgttacgtttggcataacgatgtaaatgagcattgggaatatgataagaaagatgataaagaaccggtaatgaagaacgataaggcccggatttatcaccaaccactttaattagcgtaacgtgatgaggtaaaaaatagtgttcaggtacctccgcgaaatggctaatattgtgtgaaccgtaacgcagaaccatatctattgcaggattttctccagctgctctggctaaacttgactcatcatgttcttgcaacggtatattatattcaccaacccaaaggtttaattgactggattgggtacgtaaatggctttgagctaggtcaaaatgtagaatatgcgttttcatttggattttatctctctaaatgactattttcgttatcacaataaatactcaataaccgtataaataattcggcggaaaatcccgaaaaaataatccccatgagaatgaatacatcctcctataaacttattttttaaatgataaacacctaaaactaagtagaaaaagatttatctactttacaaaaatcaattgaatgtgacatttaagctacacaattaataatattaatgcgatttcaaacttttttcatcagttaaagaagatatttatgtgacgcatagctagctttcaattttagctaattaatggtttcaattttaaatctttattatccgatgttattagtatgagttaaattaagaataaaaataatcatctaaaattataaaacctatcttcaataataaaacaaacctttaaataatggtcagaaacttacatctcagttgcttgtatcgattgcctgttagatttcaggtgctttttccttaagcggtttagaacgatccctgaaattcttgatagcaatcagatattgattcgtgccaatgtaaagatcaccattcctgttgaaataaataccaccatactcatgacagtagtttacccctctgccaagaggaatttgccagatcactcgaccgtcgaaagagtcgatcgcgctgatgtaatacatcccgccttttgacgctgatatttcgtcagaccagctacaggtatgcgcgaagatgataccgctgccacgacagagcatgttcatcgcgtaaaagtgaacatctgggatagaccattttttttcatcaggttggtcagaattttcaggattgatacggatcatatccatgccgggggcattcggaactaactgggagaacggccatgtcggatagtgaccgaaattattttcgaccacgaaagtatcaccaacaccgatcagcgaagcttcgtccgcactcttcattctcaggaaacaaggggtttcggagataatcgccccgttctcacgattacagaccactacgttcaggcgaggatcggcattatcggtaattgccaccagttcagtgccgttctccattttagtgagcgtcggggtcgttcccgagccgatatttttctgacccggtttcaggtatcctgcatttttataagaagttttccaacgagtaacaacttcatttttctccagattaaacgcccaaagatatccttccgtacataagcccttattgtcgataccattcgtaacaatataggctcccttttcatcaaccgcgaatgtattgttgttccactgtttttccagttcaagagaattgatcagtgtcgtattcccagtactcggttcgatttccacaacggccatttgcgccgaagagtttaatgtgctctctggatagttttgatagtcgaactcacctgctatcaggcaccagtagagattcgggcgtgtctcatcccaaacgggaagcgacgagtaaagagaatttccttgagctgaacctgtgactaactccactatatcgtcactctgccagtttggtgtgagtgcataaatctcattgtctcttgactgcacatcggctgtcggataactggcaattttgttgccctgcacaacaatggtgttgtcgttgttgtccatgtagaagtaaccgccaccaaaggtactaccggaatactcacccacagatgttgccgaaatgatgttacagttttcgtcgaatacaaccagccagaacagagatgaaacgtaatccagcgagacgcctatcatttgattcttgctattacaaaccatattcggtgtgtatccgaaggggttgtattgctcgataagcagaaggttgtcttcaatgggaccactgagtgacacggactcagaacaccaactatcctgatgcgggcttccaaaattatttggtgccatccatggatgttgcgggatctgggcattggcaaaacgattcagagcactttttgctgcggaaacatggtgcaatgcttcttttctcatgggaattgtatgatcgagtggattcataattgaccttgtatttgattgtgaatatccaatcctgatcttcgggatcggcgtgttgaaccttgagtcatacttcacagtaaactacacgcatattcccctgagcttcaagcggatgctcaaagttaataattacaaactatattcgatgtgtattcgaataccataacatccgttttggcacaccactccggacgggttcaggagaccataaaaacaaactggtacatcactcgtcattttcggttctgtcgcattagcagagaaagtgcatcaaaagatgaatacgattattttttatgcagcgagttgatagaaaaattcggcgggtgaaagcggacattccggttcttgcggatattgtcctttacgtaacatattaaccagctcaatgcccgctaatacgctctgcgttcgcctgaaatttttaaatcccagcatgggacatatccgccgtttgatattgcgatgatcctgttcaatcaaattattgaggtatttgttctgccggataacaatggcttcttcctttgatgttcccttgttccattcatccacggcggctttattggcaccgcttttatccatcgtgacgatctcaggctgaccatgttgacgcattgcttttttaaagaagcgcagggcggccgccttatccctctgagctgttaacaaaaaatccaccgtattcccgttcgaatcgatagcccggtagagataacgccattgtcctttgattttgatatcggtttcatcccttcgccaccggtgacccacgtcaggcattttccgacgataacgtctgacaatcaagggggtcagacggtgaacccaacgggaaagggtcgaatggtcaacatgaattccccgttccgccctcatttcttccaaattacgcaaactcagggcgtaggctagataccaacgcacgcacgggggtgatatcaacaggatagtgtaaacgtttgaaggcttttcggataaggggcatcgttagaactctcaacaaaaaatgacaggttacctgactccactccttaatgcgacagaacccttaatatgtcggtgaaggaaaaaccgcagaaaccgggctttgcgtcgctgatgaaacaatttacccgggttgacccgtaccagtgtgtattgtgtggcagccggatgttttttaacagcgcggaggcgggtatcagggcagagaaattactggaaatgtgacgtcatgcgtttcaaaaatcacgatggttacggcagtctgcgcaggaaagatctgcctgaaattcagtttattgtgcaaaaaaacacactgactgatgaaaaaccagtcaaccactcagtggtgaaaccggagaacggtcatccgtataagaggttaagatcaggaaaagaggaaaaattaacattcaatttcctaaccatcgagttatctttgttatttacagggtagatccaataataagttccaaatagatcctctttagatccaatagatccctgatcttcacagagcatatcagcaaaggcttagagccgtattgatgaccactataaagagcaaattgactgctataaagtgcaatatcgaccgatgaaaacagtaaacagacctttctggtgagtagtcgtgaccactatggggagtataggaaatatcttacccactgctgaattttcaacatatccaccggatcgatccaataataagtgccgaaagttcataaaagtccctgtttctattttgacagtcaactcataggctctaaggatatttcgaccactataaacagtaaaaagactactgtggggagcaaataaaccgctatggatagtgatatacccgctattatgaagagtatcataactgctatggacaggaataatagaccactgtaatgagcaagctagccttagaaaataaataaaaaggggattcatcttgtcggaaaattccttaataaacggggagttaataccagccttttcggaagttagaaaagaaacaggtgagttagtcacactgatgcctaacacgaacaatactgtccagccagtcgctcttatgcggttagggttgtttgtgccgactctgaaatccaccaaccgcagtaagcgaaaccttatatcctcaatggacgctaccgaggaattgaagcagctaactctcgctaagtcagagggttataacaatatcaagataaccggtgaacgacttgatatggataatgacttcaaaacatgggtcggcattatccattcattcgctaaacataaggtaatcggcgacaaggtgacgctcaagtttgttgattttgccaaactgtgcggtattccctcgacacgttcatcaaaacgccttagagagcgacttgatgaatctttgcggcgtatcgtctctactacgttatcgttcaccagcgacacaaaagcgtatcacactcacctcgttcaatcggctttctacgataccgaggcggacgccgttacgataaaggctgatcctgagatatttgagctataccagttcgaccataaggtgcttttgcaactccgagcaataaccgaattagctcgtaaagagagcgcgcaggcactttatacgttcattgagagtttgccctctaacccagctccagtatcaatggcgaggcttagagcaaggctaaatcttaaatcccgggcgaatacacaaaacgcaacagttcgccgggcaatggatcagctacgtgagataggctatttagatttcacggaaattaaaaagggtaaggtggtttatttcatgatccatgaaagagcgccaaaactaaacaaaacaaagcctgttaaaaccgttaagaaagtgaagactactaaggggagtgaaaaacagggtgatactgttttggctgaattaaccagagaagaattagaatttattgaaaaaataagaaaatcaaagtattaaatcagaatgaccgctatagagtaggcgctccttatagtggtcatttgcgtcatacttgcctgaccatacagagttttttgttttaattcaggtgacgaatatatggtgccattgatattagcaatgacccgttttccaaaatcgaccactatgatcggtgtttctttactctccatagtagtcttgaaatacataacccgtttaacgaaatgggctgcgctgttggtggttatccatattacagaacagctccaataaagatcacagtaacgaccactaaagagagtagttcctgtatcatttctgagccaccttacttttcttagtactacagccgtagcccacattatgggttctgtcgcattaagcggtcatcaggtaagcttccctgtttttgagcgagtccagagtgatgtcccttatccgaaaagcgttcaaacgtctgcattatcctgttgatattatcgcccagtgtgttcgttggtacctcgcttatgccttgagtctgcgcaatctcgaagagatgatggcagagcgcggcattgggtcgactatgccacgatacctcgctgggtgttacgtggttctgttgcaataagcaaagcctaggtaatatctcacttatttgttgataaaggtgtcgtcaatgtcgttgatactaaaagccttcaaacggttgcattatcccgttgatatcattgcccagtgtgtccgttggtatctggcctatgccctaagcctacgcaatctcgaagagatgatgaccgagcgagggatacgtgttgaccattctaccttatactgttggattatcaggctcacaccattactgggtaaggcctttcgtcgacataaacgtcccgtggctcgtcgctggcgtatggatgagacgtacatcaaaatcaaagggcaatggcgttatctttaccgggctgtggattcagacggcaatacggttgattttttgttgacagcccatcgggataaggaggccgccttgcgtttctttaagaaagcaatacgccagcatggacaacccgacgtggtgacgattgataaaagtggcgccaataaagccgcagtggacgagttaaccaaggaaaaaacaaaggataacgacatcattatccggcagaataagtatcttaataatctgattgaacaggatcaccgcaacatcaaacggcggatatgtcccatgctgggatttaaacatttccggcgagctcaaacgttattgagcggtattgaattggtcagtatgtaaaggacaatatccgcaagaaccagagtgttttctttcacccgccgactttttctatcaattggctgcataaaaaacaattacatcattttctcttgctagcgctctgttaatgcgacagaaccatattagatcggggttaaagggattcccaatagcttcacacattattttttttcgtgtagtggaaaatgggataaccattgtcagaattctacatcaatctatggattataggcgacacattgatgagtaacgatctacattaactacaaaatggttcagaactttattttcacccaagatacaataattagttacaacataaatatgatgtgttctgcctaccgcgaaagaacgagcctgcattgatcgtggcaatttttcacaaacgcatgaatttgctaacgcgcctcgccgactggctgagacaatattatggatttttaaggaaatatatataaataaaagggaaaatgtatgagcgattgggaggctgtccctgtattggctgcattggatctagacgaattggttgacttttacacaagtaaacttgggttccattgcgacaattttgttcctaatgaatatgcgataattagcagaggggaagctgaaatccatttttgggcatgtaacgataagtacattgcagagaacacttcttgctatcttttcgtgaaagatatccaaagtgtgtttcaagaactacaagcgcagactgaagtctctccgcttgcggaaactccatggggcatgttggagttccacctaattgatccaagtggaaatttacttaagtttgggcagccagtttagctgtttaacgttctccccaactcctgtttattcaaagtatatggacatcgaacttgaaaaatccattcaaacgtatggcttctttttccgttgaaaagaagatagaaattcaagcagctacaattacggataacagcgttgtattctaaccggaaaaaaggcacatttagagtaaccggttctgtcgcattaaggagtggagtcaggtaacctgtcattttttgttgagagttctaacgatgccccttatccgaaaagccttcaaacgtttacactatcctgttgatatcacccccgtgcgtgcgttggtatctagcctacgccctgagtttgcgtaatttggaagaaatgagggcggaacggggaattcatgttgaccattcgaccctttcccgttgggttcaccgtctgacccccttgattgtcagacgttatcgtcggaaaatgcctgacgtgggtcaccggtggcgaagggatgaaaccgatatcaaaatcaaaggacaatggcgttatctctaccgggctatcgattcgaacgggaatacggtggattttttgttaacagctcagagggataaggcggccgccctgcgcttctttaaaaaagcaatgcgtcaacatggtcagcctgagatcgtcacgatggataaaagcggtgccaataaagccgccgtggatgaatggaacaagggaacatcaaaggaagaagccattgttatccggcagaacaaatacctcaataatttgattgaacaggatcatcgcaatatcaaacggcggatatgtcccatgctgggatttaaaaatttcaggcgaacgcagagcgtattagcgggcattgagctggttaatatgttacgtaaaggacaatatccgcaagaaccggaatgtccgctttcacccgccgaatttttctatcaactcgctgcataaaaaataatcgtattcatcttttgatgcactttctctgctaatgcgacagaacctttgtatctcactttcatttcataacctcaattagggtagattgaaattgttgagaggattattatgttttaagagcttgtttaattgtttcgaatggtatgatcaacttctgcgcagaagataatggaatcgctccaaatgattcataccatttagctactgcttgattcttagcctcgataaatagtccgattcccccaatttgttcagcgacttttaggcaacgataaccagctaagatcagtaattgccctccaaatccgttattttgaaaatgtacatcaatagctaaacggcatagtaaataaactggaacagcgcgcttagctaaccctttggataaactattaggaagatcgtcaaaatttatagatgaaggcgtaacggtataataaccaataatctttttatttgagtcattagatgaaattgcgacatatgttttactaacgttattcttagtatcttgctgtgccaatttttgtagataatcattcagtgcgggttctccgcaattgaatgattttcgattgtgagacttgtctataagttcctcaatgaacatggcttaacttatccttgaaaatttttagaagctgaaatcgccgctgcttttagcttatcatttggtttagggggattatctaaaagatccaagattaattttttgtcactatatgataatttgagactttcattttcattgattactctttgcgcttctttcattgctgtttgtgtaacaaaatcagttacattcacacgtaagattgatgcagctaattgaatagactctttaatttcagaattaacccgaaattgtaatcgctctgtagctagtttgatatgtgtcatatgaatcacctttaatacattttttcgtataaagacatcatactagatgtctacttaatcgtcaatttgtaagtgcattgtgagtacaaatttaaaatttggcctagtaggggtgcgcttggaattcggaaaaatcagtaaagttccctctatgttacttactaactgctctacaaaagggaacgcttgtaaagtgtcacattatgatggcaggtacatctctttcaccatcattacgcacaaaaacgtgaccatcaagcggctcgccgcgctcaccctcctcaatgcggaaggtgagcctcagcaggggattgaaatccggcaaaataaatacctgaataaccgcattgagcaagaccctcgccatgtcaaacgtcggatacggccgatgttaggctttaaatcgtttcgccgggcccaaacgattttagcggggatagagctcgtttcgatgctacgtaaaggacaatactcacaatcagaagataaggcattgtcaccggcagaaatgttttaccgattagctgaataaaatataaccaaccccacattgactcagattttctctgttaatgcgacagaaccctagaggctaatgagacgatgaggcgttaccgcctactattaacctcctgaatcatagatagaatgccacacgcttaccggttggaagtgtcacatcaatacttaattcccctcctaaggctgccacatagcgcttgagcgttgagaggcgcggatcatgatccgcattttccattcgagcaatggaaggctgttgaacacccataacggcagcaagctccgcctgtgacatgtctaattcatcacgtaactgactaagggctaatttgatgctagcctgttcaactcgcttttcaatacgtgcctgcatttctgggctttcttttgctaacaattctctgtaattagccataattatttctccaagtgacggcggtactcaaaatcagcttgtcggatcatttccttgtagaaccgtttttcatttacccctgttttattgccagcacataaaacgattgcccgccgcttagatggtgtcgtcataagacatttaaccaaagagcaagacagcggatctgaacagtagcaagaaatgaggcactatttttggcataacgggtcgctataccccgccagcgtttaagatgaagaaaagcattttcaactaaatgcctgagtcgatagagttcccgatcatattctcgtttcactttgcgattttttcggccgggaatttgcgctgccatgccttgtttttctgcttgttcaacaacggtattactgtcatagccccgatccgctaataaatgttctgcatctattccgtcaatcaaggcctcagcttgtgagcaacccgctgtgggaccgcttgtaataagcgctctgatcggcataccatgcgcatccacggccagatgtatctttgtattgagcccccttttgtgcgccccatatcctgattgcctcctgccgcccctgcggcgtggggatgaaccttaatatgactggcgtcaatcatcagccattcgaaatcgggttcaaagatgagttcttcaagcagttcttcccatacgcctttgtcccgccaccaacaaaaacggcgatgcgtatttttccagtcgccataatcgggcggtaaatctcgccagggtgcgcctgtccgtaaaatccagaacacggcattaataaataatcgattatcataagcaacacgcccccaggctcccttacgtcccggcaggtgaggttcaagcaaactccaaatatgatcggaaatatcgtgacggcggtgtacgggtgtgctcatggttaagtcatccattcatgtaatatagggttattattacatgaatttatttatgacgacaccatctagggtcaaatgcaaaaaaagctctaatcggatcacctgcgtgttgaacacgcaattccttcatgtttggaaaatctgagccatgtagcgtatcaacataaggcctaccgagattcggcccgaatttctctaatacacccattgcttcgtaaattgattccctgagttcatcatcctgagccagaaaccacccgtcaaaacactctgtcgttataacttcccacatatctgcctcataacttattcgttatgattaaaggtataacatatttgttatattatcaagatcaatgttgaaggttctgtcgcattaacagagaaagtatgagtgaatatatcccccccgttcaacgagcatttcttcgatattacgtaggctagatactcgcgaacacactgagcgatgatatcaacaggatagtgcagacgtttgaacgcttttcggataagggacatcgctctggactcgctcaaaaacagggaagcttacctgatgaccgcttaatgcgacagaacctttcggatcaatgacatggtcaggtaacaccataaaaaaacaacatgttacccgacgatgccttaatgcgacagaaccccttaaaatggtttggtcggcagatattttccgtcgagcgtgattactgcacgctcaccaccttccggatcggcaacctttttcacgtccagtttgaaattgatggcactgatgatgccgtcaccaaacttttcatgtaccagcactttcaacgtggtgccgtaaacctgcagcatttcgtagaaacgatacatggtcggatcggtgggaatgcgatcctcaatgctgccacgaacagggatagtctgcagtaacatgatggcatcgctgtcaagatccagctttttgccaacaatattagccactttcgccggaagtgcatgctgtcccaggagtgcggcggtgacgaaggcttccgataaaccagtgccgtcggcaatttgggcgaacgagagatctttcttcgttttgactgaccggattttgtcggcgagcgccaggcggacttcgcggttaacttgtgactgaatcatggtgatacctcatttgtttacagttgaaattaatatcagacggcgatgactgccgaacaggcactgcacggacatcagggttgtcagccatcgaagccgagaccccaccggattacggactgtagttgccagcattacgatcacaaacagatcgctggattcacgttgtgtcaccaggttcggaaccatacggctgtctgaacaggagataaacaacgtccgcgggctttgctgtgtagccaggcttctgaacagctcaacgcgctcagggaaagtatcactctgaaatttaagaaagtcgtcaataacttttttcattgtgaatcttctgtctcgctgtgggatgcggtgaaggttacaccccatattccataaggtaaaagtctcgtttatgatgattatcatctgaaaatcttatgggtgattgtcatgaatttccgttatatcaggtattttctcgccgttgcagaacaccatggttttacccgagcagcaacagcgctgcatgtatcgcaaccagccctgtcacagcaggtcaggcttctggaagaaagcctcggcgtgcagctgtttgaccgcagcggacgcaatacccgcctgactgatgccggagaagtttatttacattatgtttgccgtgcatttcaggaactggatgaaggtaaacgggctattcatgatgtggaggatctcagcagaggttcgttgcgtgtcgctgtcacgcccacctttaccacctattttatcgggcctctggttgccgaattttatacgcgttatccctatatcacattgcaaatccaggaaatgtcccaggagagaatggaagagcggttaattaacgatgatctggatataggcattgcctttgatggcggagaatccccgggaattgcactcaagaaccctgctgactgaaacccttgctcttgttgtggcctgccaccatccgcgggcacagcagcgcaaaatcgccctgaatgaactcaacgatgaaaaactcattctgctgagtgcagggttttctacccgtgaacagattgatcgctattttcgtgagacagatctgcgcccgcaagtgcagatggagttcacttccatctgcgccgttttagacgtgatccgcaggacatcgctttcaaccctgctcccggcggcaattgccttgcagaataatgatctggtagcgatcccgcttgctgaccgacaactggaaagaacgggggtgttgatgcagcgaaaaggggcatggcaaacagcggctgggcgggtgtttattgaagttgcacaggagttggctgataaaacggttcctcgatataaatatacataagtaggttctgtggttctgtcgcattaaggcatcgtcgggtaacatgttgtttttttatggtgttacctgaccatttcattgatccgaaaagccttccggcgcctgcattatcccaccgatgttatcgctcagtgtgttcggtggtatctggcctatgccctgagtctgcgcaatctcgaggagatgatggctgagcgtggtgttatcgttgatcattccacgcttcaccgttggctcatccgtctggtgccattgctggataaggcatttcgccggcataaacggtcggtaggccgccgctggcgaatggacgaaaccgacaccaaagtcaaaggccagtggaaatacctgtaccgggccgtcgacagcacggggcagaccatcgactttctgctcaccgccaaacgggatgccgccgccgcgttgcgtttctttcgcaaggccatccgtcaccacggcgaacctgaaagggtgacgatcgataaaagcggcgccaatactgcggctctgaccacgctcaatgccgacaaacctgaagaggaaaacatcaccctcaggcaaagcaagtatctgaataacctggttgagccagatcaccgtaatatcaaacgtcggatacgacagatgctggggttcaaatcgtttcgccgggcacagacgctcctggccggcatcgaactgattcacatgatacgcaaagggcaatatcaacatccacaaagtgatggattatcacccgcggaacaattctatttgctggctgcctaaataaccggcaacaaaggataacgacattattatccggcagaataagtatcttaataacctgattgaacaggatcaccgcaacgtcaaacggcggacacgtcatatgctggtattcaaaaacgtcaaacgggctcagaccgtattggccgggattgaatgggtcagcctgttgcgcaaaggacaataccgacaaaaagaagggtgtccgatttcaccggcagcctttttctatcaattagctgagtaaaaatcaatcaccttatcttcactcgtactttctttattaatgcgacagaaccgcctgacatcattaccctcgataagagtggggccaacaccgccgccattgccttgctgaataccgataaatcaaaggatacggccaatgttaggttttaaatcgtttcgccgagcccaaacggttttagcggggatagagcgtgtttcgatgcggcgtaaagggcaatactcacaacccgaagataagacattgtcaccggcagaactgttttatcgattgactgcataaagagtcatcattcccacctccgtacaaactttctctgttaatgcgacagaaccaaaaagaggggaaccatagatttttatgctctcagggacatcgcagtcagctcggttttctgctggaaattgccgcgggtctcattgcttatacattccaacctaaaaaaaccgagcctgaatttacggggttctgaactggctcttcttaaacgaagctgaggttaaatagtaatcattcccacctccgcacaaattttctctgttaatgcgacagaacctcttagagtcaatctatttgcgctgtaattttgttggaaatttcttccacctcatacaatttgtggatcgtgataccatggattaatgttgacttaagcggaattataatgtcgtgaattgggttatgtagccacagagctacaaaataacaccaaggtaaattaagttgcctcacttcatagccttgctgttgaactctgctatccatttctgctgcaaggagcgcctcaactgtcgagactggtatcgggccatcaagggtcattgaagagacgatgagatttgcatcgtgcatgttcaaatggagatcggacacagcagagccgcctgaccacaatagataccgccaacctgtagagcgggcagccttgatcaaggatttcgttttttcaaattcattgcaatcgacatagtacattttaatcgggttcgacgatgagacgtcgttggtatttattttattgtttgtatcagcttcgctaagcgagcctccatctataatatcttgcaaaaaagaaactataacactatctgccccgcttggagcactcacaaaggtaatagtcatttgtgtacctcatgtattatattggttttttagtaaagcaggtttgttcccatttagccgttggatctccatagtaatataacgggaatgtcttgaaattctccaacgttctcgttttgtcccacgggttgcatacttcccaaactgaatgaaacggcttttcattgaatacagctgatatcaccactgcgtgccccttagtatcacctaaactggcaatttcgtgtgagaaaaaaacggcaacgacaagtggcctgttattgagtagttctgttataataaaaggcacataaccttttccttttattgctttctcaaacgcccctatcatcgccaaggaccggtctggcattccctcctgattgcacttatcattatttggaaagtggagatagggagctacacaagctccaggcggcgtaatatttttggctttctcataaattggcgcttgtcggtaataattcggcttctgcgcataataactgcctatacttgcagccacagcgatccagcaccaatacgtttgctcctgacgctgcatgtaccctttactccagaaatccgtgaggtagcctgtcttcccatcagaatacaagctgttggtttctatgctacgcttggaagcagaaagcgccactttttttaaagaaaggcatctcggtaaattactattttgaatatcagtcatgttgtcctcacttgttgaaaatgtgactccagttttagagttttaaatcacgaatctcattggattttatgtccgcaaattataaaaactacattattttgtgttaattttaaatgcacacactatgtgctaattttattagaattagagtccattaaaaaagtacaaattattaaaccagactgagttctcctaaaaactatatgtgtgctaaattagaactcccgcgagttactgctagcaccttccggtccttctccaaactgggaataggtatttctctcttattcggattttctgtattatttctttctatatttagctgtgattacttctatgaaacaaaacactagttactaatgttttgtgtcgtcgtgatgctatccttttgacccatagtaggttcgcctgatgaatcgattggttcaaatgtcttattacaatagtattagactccaatcatgaattttaggtgcacaaattgcgcttggaatgcgtgccacttgtccaagtggtataccatgttagtcgatacccatatgtgaatccaccaccaaggtactataacttagagccatttattactacatgttggttactggttgccaacgaaaaaatgtccccatgaatttacaatctttattgaccaaatctgacttcagtctgtcatttgagggagtgctcatgtcaaatgaatatattaatttttagataattaaaaactgaaattaacatattttaaatataattatatttattatatttttacctttaacacacagtataagatttatttttttgttataaacatataaaatttatcagagataccttaataaattatccttatatcttgattattataattttcgcagagcgataatttcctgactgatcatcaggaatgctattgattggatgaatccttatccaacgtgtcagaacaacatcctgtgttttacgaagatgaaatcgatattgaccttaaccccaaaatcggggcagactggtgtctgaaagggcaataaaaacaggtcatgacgccgggaaaaaatcaaaaacacgaccttgtaggctgccttgacgcccaaataggccaagtgacttatgtcagcggtataaagaaaaatgctgatttatttatcaaaatgttaaagaaactgaatggccaatatcgccatgcaaaaaaacatcacgttgattttagataactatggcactcataaaagccggaaagtcatggcatggctaaaaaaaatcctaaatttaatctgttgtttttaccggtctattcactatagataaataagattgaacgcctatggcaatcattgcatgaaactgtcacatggaatcattgttgtcagtatatgtggcaactcttgaaaggtgttgaaaaattcattaactcatttataaaaacttatttatctcttatcccaaaccataatttacgttaaaataaatataaacaactaaaaacaaacatacactataaataaaaaaacaatattatttatcaaaaataagaatgggatcacgtattaaaagtgtgtattatgaatttaattgtattgcatctaatgttgtttagtgcatataaactgcagtaaaaccttaatcgtagagttgtactgcaatcacagttttcaacatattaaatacataactaagaaaggataaaaaatgttaaatattcttccggcgtcaattttagtaaaaacattgccaaacaataaaattggatttactgcacgtaatgcaacaacggttattgattttgaaccactagattatacctcagaaataggaaacacattaattctcgctgggcaggctttgatcacagcaagttctaataatgctccaggccctttcttaattgaatatgaaatacgcaatggtttaaatttttatgtaggaatgattataccaattgcagaaatgccttaatactgatcttatagcctagggcgtgttgacgttttgtgaaggtaatctgaacagcatgatgattgggtataatcaatttcgccaaaaactcattaagcctcatcatcatgctacgaacggttctgtcgcattaacagagcgctagcaagagaaaatgatgtaattgttttttatgcagccaattgatagaaaggtcatgactccaaagcgttaacctgatattcttatgcctttttaaggggatctcaaaatgacggtgacgatagaagttgcttgccggtattgtaaccaaaccgaaccggtacgcaaacatggagcaggtaaagccgggtttcctcgttattattgcaagggttgccaaaaaaccttccaactcaactctcgttacaatgaccataagccgggtatgaaagaaaaaattgtcgatatggcgatgaatggctccggtgtgagagacacgggacgtgttttaagtatcggtatcaatacggtaatgcgtactttaaaaaactgtcgccaaaacaggtaacatcaaggcaggttgtttatgatgatgtcaccctcatttgtgaactggatgaacaggggtcttttgtgggcaacaaaaaacaacgtcattggctttggtatgcttttgatacaaaaaggaagcaggccatagcccatgtattcggtcctcgaacagatgccacctgcagaaaactgctcgacttattagccccttttcatattcgtttcatcacgaccgatggttggggaagttacgccagagaagtcgagccagaaaagcatttggtgggaaaaattttgacccaacgtatcgaacggcataatctcaatctgcgcatccatatcaagcggctggcaagaagaaccctttgttattcacgctcaatagaaatccacgaaaaactcattgggacatatattgaaaaatatcattataacgctttgaagtcatgaccccaactgaaagactttgcaacagtcatagcagcgataacgaggatgtccctcattaccttttccatgtcctttcactttttctgatttgagataataacgacaatcaatgtcaactttagccatacttcaccataaaatatcacattaactaactatgcaatacattacctgcaatcaagccgttatttcagaagcttttcgccatctttaagcttgataagtgtttgtacgaaaggaattctcctcttaagcagagtacagatttttttggcaggcagtggtttatccagaacatgaaacccatccagtttttgataataggttttatcttttacaccgagatgatctgttttcagcaccttacccgttgctgagccgtaagcaacaatacctacgcctgattcatacaaaaagacagtatctccttcatggattttttctattttctgaatgtaaccttcttcaaatgcagcagcaaagccattttcaatcataaattggtgatccttagcactattggctttgtttgtgttaagcagaaaataggtcttcgtatggttatcaccagatgcacctccgcaactgagttcagcatccagttcttcgtttctcatcacctcccattcactgagtgcgtatttttttattagctcataaagaagatcctgccggttacagccaactgaatctaccaaatcctgaatggccgcattctcctcaacactgacacgcacacttaatgtaaccagatctcgttcacgatcttgatatacttcctttaagtgactcaaaaaagattcattcatttattatcctattgattaattttatcgatatataatagtacatgctaataaaaaaataataaacactatatatgaatcaaaattaacaaacggaatgtgacatttatgtatgcccaaatatcatgtactaaaacgttcggtttcggacaacctgcagcgacactgtacgaaagtaagtgttttttatttcgtacataagctataattagtagggattctaagccggaaccgccgaaaattccgtcagccgaaattcagccctgctataagcgcatcaaggtcaataattttaccttcgttctggaaggtataatgcccgttcagcaaaatatgctgccaggcgacggggggcattttggttatcaatgccagtgtcttgatgctgtctgatacctccggtttattcagtaaccgggataaaatcgcggagttatagtagatgattgcgttagcaaccaatcgcccacactgattactgatttccgtttcgatgtcggttcgtccggtgagttcctttttgccgccgacctgtgcgatggctgaacggagttgatgataagattcaagccggttctgtgagcggtgtacattccgttctaactgaggatcacgcaggtaacgcaatgtgtagaggctgcgtaccaaccgatcatactcaaagatagcgcgtcgcgttggattgggtgccgtataagtacacagcttacgaataagcagaccttgtgtcatttctttcaaccccaacgtggcaacaatccggtcaatattggctttttcgcggataataagttgccggtcaatctggccgacgggttgaatcaggcattttttgtacatttccgggtcattagcacaatacaacatctgtagttgtgcattcagactggtgaaacgaggctcaaaacgcaggccaaaccagtgaaggatcgcgaagttagccttattaacactgtgcatatcaccggtgatggcggttggcacgatattcgaggtgttgcgataccagatatcaaagacatggtaagcctcatattcgtttgggcctatcagatagccgttgagaggtatatggttacacaatagcgtgtaggcgactacacctttgccacgcccaaaatatttacgtgaatagcgggctttcacagttgtatgctcaaccccgaatttctgtccatcgaccgcaccgtacagaacgtcaagatcaaacgaataatgcggaaagataggcagtgtggcaatcgcattactgatgcagtcattggcggcctgtaatgtcgcctgacgcagatactgctggtaagtattttccagaatgtggtagggaatatcactggttcgcgacatcacctgattaccgtggttcatggcctgggcaataatgacggccatcagactatcagtttcggcttgttttttcgcataacgtggctgtaaaggtttcattactgatagaaaatggcactgttcattcacgaaactgagtacatcggcaatatcgcagaacggcagctgggcataaaatgtttgctcttgaggttttcgattatccaccttgggtttgcgccaatgtaatttctgtgtgtccttatcgtattccagatgcttaagctgaccttgtttcagttcgtgattgaaaacctgccattgttgatgtaattcagatgacagggtatccagcaaaacatcaacaggttgctgtaggaaagggatctccatttgcgccagaacatcgcgctttttttcatttgaaaccagctcgtcggaaagatggcggtgttgcaggctgccatcaaggtaaaattcgcctgactgaaaccgttttcttatctgacggtatagccagaattcatagcggtcggcgtgcaaatgagccggatttccatccgtgtcaaatatcagcaggtacgggcacagccgctttggtaatgttgccggcggacattcagcaagcggccgttgcgaaaaacgctgtcttttgctgaagatatctttagcccagatgagcgctttaagccatggactggcaggatcaatacaggcaaaatccagcacggtatacaacggacgcaaatggcggcgaacacgcccagataatttgtctactgattgccagtgtagtgccagttttttcagtggcttatcgcgcatacgccgtgctgtattttgcaccgcgtctcttggcataattgcccaggcttgctgacgtacttcaccaaacggtgtcatatcagatacccgatcatcgacgtacaatgacagcaggcgacccacctgtgaagtctcctgatgacgtttgtcttgttcatcagcgaaggtcttttttgcgatagctcggctttcatcctccagttgcttcatatgaaaggccatcgcatcaaccaggttgtcagtaaactgccgataacgccaccaggcataacaaagcaaatagagccgggtttgatcggttttcagattacgcaaatcgtaaatagtgtaaaaattcaccaaacttgcgtaatgcagtaggttctgctgtgaaatacccaatctggggtgtaacactttgaaaatttcatacaatggtttcagcgtagcacgcttttcacgctctcgagccatctgacgccagccgaaatctttagcatcttgcctgagtactgccagttgagacaacgtatcatcacgtaccagcagcttatccagtaaggctgtagccgtttcgtccaaaacatcggccagaatatttcccagacgctggcgttcaacagaaagcgcctggctgaccagatcctgtagtgtggtgtaaccgggtcggacaattttgttttggttgagccagatgaccaattcggcggcaacaaaacccggggctgcatctcgccgcacgatatgagccgcttgttgtgtgagctgaggccgaaattccccagaccaagactgatagctaaataattgggtaatttgctcacgctgagtgtaacgttcatgtttagtgatcagttcgctcccgaaagattcatcatggaagtagtggcttatcacgaaagcgcaatcgtcactgacctcatgccagtcaaaacggaaaaaagcctgcttggctttgaaataaccaatctgaagaatgcaatagagttggtcatgcaggcttggtcgattattggcaagagccagttctaattcagtcaatgccaggaattgcagcctctgcgcatcgttaaaatcaggcaaaccatacaaggcttcttgctcagcatcagttaatacagacagcctttcacttttaccggttattttgtttgtatgatgagccatcacgttgactccaggaaattcatgtccgtaagaggatcgctcagcgaacagtaaaaaataattattatagaatgatgcagcgcggctgaagttgtctcataaaaatggtacggtatcaatctctttgatggccccttaatcgtacatatttatgacaaaaacattgattggttatgcacgttgctcaacagacaaacaggatttggctgcacagcaggaggcgctactccaacttggcgtatcccctgaccggatttatatcgacgaggggttaaccggctcaaaccgattgagaccaggactggaccaggcactcgcagccgttcgctgcggcgatacgctggttgtgccaaaactagaccgacttgcccgttcagttcctgatgctcgttatatcgccgactcactgcttgctcgtggggtcaaactggcacttggccccagtgtttatgatccgacagacccgatggggaaaatgtttttcaatatactggccaccttcgcagagttcgagggagatttgatacggctgcgcactcgggaaggtatggccattgcccgggcaaaaggaaaactacgaggtaaacaaccaaaactctcggataagcaacagaaagagctatgccgcatgcacggaacgggggagtactcaatcagcgatctggctgaactgttttcagtatcgaggccaaccgtctatcggactcttgcgcgtacaaataatatttaagagtagattatgctcagtaataatagatccagctatgatcagtttatccggagtattcatgcttaaattttattctttagttagtctattatggttatctatttctgcgcttgctcattcatcctctgcggtcggttttaaagaaattgacctagataaaggagaactcaggccattgagtgtagcaatttggtatcctgttaaaaatcaaaccaaaactataaacatcggcgacaatcagactttttatggaattaatgtcgtgcagaatggagtacctggttccgacgaatatccactggtggttctttcccatggctatggtggtagttggcgtaatctgagttggctggccaatgaattaaccggtcagggttatattgtagcggcgccggatcatcccggtacaagtgtatttaacaaagatatggaacaagccacaaagttatgggaacgaccacatgacttgagtcgagtgatcgacgctataaccacagactctaaacttggtggtaaggttgatatggaaagaatagcagctattggtcattctcttggtggatggaccgttattgcccttagcggtggacgctttgatacaggattgtttaaaaaagactgccagaagtattcaactctctgggcttgcaaccctgttttagtacttggacttgaaaagccagaactggagagaaacatggaagactcacgcataaaggcgtttatttccctcgatgcaggactgatccggggtttttcctcagagagtttggcaaagatacatatcccttctcttattattggcgctggcacagatgttggagatatgccggtcgaacttgaatccggctacttgaataaatatctctcgaaaacttactcgacctatgtcgaaatccctgatgctatgcattttagcttcatgcaagtctgcaaatcaggcgctataggattacttgaaggtgaaaataaagatgatggaattatctgcaaagatggcggaagcagaaataggaatgaaatccatcgcgaaattgcttttcttgtgacgggttttttggctaaaaaaattccaaatgtttcgcattgaacgtagccaagtgtggtagcggccacaattttcacacatcgccactacttccggagctacaagcccgacaaaattttggacggttccggcttacaacccctagacgctgtcgtcatgatattttcagccaaagaacaaggcaacggatttgcactgcggcaagaaaagacgcgctattttttgcatagcgagtggctataccacgccagcgcttaagatgaaggaaagcattttcaaccaaatggcgaaaccgatagagttcacgatcatattctctggcggccttccgatttttccggctagggatatggacttgcatgccttgttgttctgctttttctactattgcgttgctatcatagcccctgtccgccaatagatgctctgcatcgagccctttaattaaggtctccgcttgtgaacaatctgctgtggtaccgcttgtaataacaattctgaccggcataccatgcgcatccacggccaaatgtatcttggtattgagcccccttttgtgagccccatatcctgattaccccctttagcgcctgccgcatcgggatgaaccttaatatggctggcatcaatcatcaaccactcgaaatcggggtcattaaccaattgttcgagcagtttttcccatatccctttatctctccagcgacaaaaacggcggtgggtatttttccagtcaccataatcagtatgtaggtctcgccaaggcgcacccgtccgtaaaatccaaaacaccccattgataaaacgccgattatcttcagctacacgcccccaagcgtcttgacgtcctggcaaatgaggttcaagcaggctccagacgcgatctgaaatatcgtggcggcggtgtgcaggtgtactcatggttaatcaactcttatgatggaatggtggggcattattattgcacgaaatttctcatgacgacaccatctagtacatcattttcgtacacaaagtaacgttatgtcacgagtttttgcttactgcagggtgtctacccttgaacagaatacagaaaaccagcgtcgtgaaatcgaggcggctggatttgctatcagacctcagcgactgattgaagaatatgtaagcggatctgttgcggcgggtgagcgaccgggattcacgcggctgcttgaccgtatggaaaacggagacgtgctgattgtcacgaaacttgaccgcttaggacgtaacgccatggatatcaggaaaacggttgagttactcgcagactcagaaatccgcgttcactgcctggcattaggaggagttgacctgacaagtcctgctggaaaaatgacgatgcaagttatctctgcagtagccgagtttgagcgtgatctgttactcgagcgtactcatgctggtattgcgcgggctaaagcatccggaaagcgttttggccgcccgccggccctgagtgacgaacaaaagaagacggtatttttgcgtataaatgagggaaagagtatcagcgcgattgcacgcgaattcagcaccacgcgccagacaattctcagagtaaaagtggcaatggaagacattgacgctcctacgtgagcagctcgttcacggtagctaataacatacaccttacttattctatggcattattgagcatggaatagcttaactggcagtccgctttggggcaagtatagtcattcacaccctgaaaattacactgtgaggtaattcagggtgtcattttcagaagacgactacaccaattaatagggattagaacctggtgtgcatatgacttctgataaaataatgtcagaagtcggctgcactaaacgcgattatgctcggtactcatgtgcaccaagacgcagaactacgctggatgattggtaacatagttccagcaatcgagtgcatatgacttctgacattttgtgcagtcgtcttctgaaaatgacagtaggggcaagggatatggggaatgcctctaatgctttaagtgagctgaccaatattacccttcttccacttgatctttcggatataaattctgtcagggcattggcggccaggggttgcacatggtttgtttggtgacgattatcagatcacaaatgaagccttttttctatctacaataaacggttatcgctaaagatcctgtatataaagtacatttagttgttcattgtctatcgtaactgaataaaatatctatagttttatgttctcactgagttgcacttacttatataaatccaagatggatttataattaattatatttaaacaatcgattgtatttattttattttagaccaatggaatcaattattatcaccataaaccctatggaatttaaataactaaataaatataagatggctttatttatcttcattaacttataaataaaaattaaatatttaaaaaggaaattgattgtgtatatttatcttgctgctacaaaattctgtatcagctaataatcaaaaggacacaagcatgagaaaattacaacgtgaaatagctttaaataatgcgaaagtaataaataactcagagaaaaaacaagaacgtaaagtgcttgttgaaaacctgatggatagtgtttctggtggttgggtcaacgtctttgcgcgttgggataaagccatataacctgatattcgtgcagggtaatcaccctgcacaacactaactgtggggctcaccatgattacaaagaaaaaaataaagcatcttgaaatcattctaaaagtaagtgagcgatgcaatattaattgtacgtattgctatgttttcaatttgggaaatgaaatatcaataaattcaaaacctattatttctcatgacattattaaagttctgagagcgttctttgaacaggcatctcaggaatacgatattgaaacaattcaggttgattttcatggcggagagccattaatgatgggcaaggaaaaatttgaaaatgcttgcaacgagtttatttcagggagttataataaaacaaaattcaacttagcatgccaaacaaatgccattcttattgataatgaatggattgatattttttccaaatataatgtcagtgttggtatatctattgatggacctaaacacataaacgacaaacaccgcctagacagaaaaggccgtagtacctatgaaggtacagtgcgtggcttggtgatgttacaggaagcttggagtgcggggcgacttatagatcaacccggtattttatgtgtagccaatccgtcagtaaaaggagcggaaatataccgccattttgtcgatgttttgaaatgcaaaaaatttgacttccttattcctgatgaaagtcatgatacatgcacaaaccctgatggcctatcagatttttattgttcagcaattgatgagttcttttctgatgcagatcaggatgtatatgtacgttattttcttacacatatgcaatcaatgttaagctcagaatttagcccagtaatggggttaagtaaatcagggagtgacactatcgctctcacggttagttccgaaggtgatatttatgttgacgatacgctcagatcgaccaatgatcctatatttacaccgattggtaatgttctaaatttgacgctctcagaaactattgcttcatggcagatgcaaaagtatatgaccgtgaataatcaactaccaaccgcctgtactgattgcatctggaaaaaagtgtgtggaggtggtcgccatattcaacgatattcaaaagcagatgatttcaaacgtgaatctgtgttttgcccttcaataagaaaaatcatgagtcgtgctgcttcacatcttattgaatctggaatatcagaagatatcataatgaaaaatttgggaattaaatcatgatgaaatggttttcattgctaatattcctgttctccggaattagtatggcggatcttcctactgatttttggcggcttcgatatgacgaacgtggcctgccgttaatagatattaagattgacaacaaataccacacgctaatgttagatactggtagtggggaaggcatgcatctttataaacatagtatagaaaaattagttgctaatccaagtctaaaagctacccatgaatcacctcgtaagctaattgatgtttctggtggtgaaaacaacgtttctgtatggaagattaatcgattactcatttccaatatcccttttgataatgttgaagttgttggttttaaaccgtggggtttaaccataggaggcgaacaacctattaacgaagtgttgggacgtggaatgtttcacaataggctagttatgatggactttaaaaatgatcgactacagatgttagaacatcttcctgcagacattaataactggtcatcctatccactagaaaaaacaaagtcaggattacgtattactgcatacatgggtaacacacctttacatttgattgttgatactgccgctagccactccatcttgttctctaatcgcttgccagtcggcactctttttttaggttgtcgtgctattgatcctgagtcatccaattcagaatgcagagtaacaaaaataaatttgatagacgaaaaaggcaagtttcgtgatgatttagtcattgtacccaatgggttaactcctaaggaactagattttgatggcctgctaggcatgaattttatgcgataccaccaagtcattatcgatatgcgtaaaagcgtgttctatatcaatcgttaatatgatgaacaaagagaactctatttttcgccctgaggctttacaatataaaaaaaatgcgtggcttggtgattttaccgtttcagcaccatcagtgctaccggttgccctgtggtgcgccattggagttttgttggtgataactctccttttatttaccacctatgccaagagagtatctgtaaacggtcgaataatctacacgcctgccgctgcagaggttgtgtttagtcaagatggagtaattgaccatatcaaggcacaccaaggggaaagagtaaaaaaaggagacataattgcgacgttttcgcgtgatgtaacctacgccggaggcagggtgaaccaggcactgctggacactgctcagcaccaaataaccgaattacaaaagcgagaggtagagcgtcgcaaagaaggagaagaggaacgtcagctcttacgcgaagaaatcagtaccaaagaccttgaaattgcagctatccgggtcgcagtcgctgccgaacaagaacgttctgtcagcctgaaaaaacgtatggctttttatcagcagttgctccaaaaaggcgtcactactttgcaagaaaaaatcgagcgcgaaaaagaatattataattccattgctcaactgaacatgcatcgaattagtatagtgcgtgcacaagaggagcggcttcaattagtggacaagcttgctcgctcagaagcacaagaaaaacaatctatcactgggatacaacaacagaaagtcactctgcaacaacagatgattaatgcatctgcgatgatggagactcgtattgtagcgccacttgatggtgttatagcatcaatgaatttattggaaggccagagaattacagagggcaagatcgcagcaggtgtagtgccagaaaacgctcgtccactcattgaaatggggattcctccgtctgcgttgcaagaagtaaaaactggccaacatgtagtgatgcgggttgcatcacttccgtgggaaaggtttggaaaagtatccggcaccattgcgaccgtaagtacgagtcctgaggggcttacgggaaataatcaacgatttcgtgtactgatagtgccagaggctggtacacacgttcttcccccaggggtagaagttgaggctgatatattgaccacgcatcggcgcatctgggaatggcttttttcacctgtaaaacagagtattaaccgcattataaatgagagttgacaaatgtttttttcctggaaaaaaaccccgctgattctacagtcagaaacaaatgagtgcgggttagcatgtttggcgatgataactggctattttggtaaacgcgtagatctcgcatcagcacgtaccatccatgaaacaactagtcacgggatgacactacgggaacttataacggcatttgaacgggtgggaatgacggctcgtgcttcaagaatagagcttgacgatctacgttcgctcagccgcccggttattcttcactggtcattcaatcactttgtagttttagtcaaagtgtcacatcgtagtgccgttatccatgatcctggcattggtcgtcgcagtatctcattgcgtgaattgtcagacaaatttactggcgtcatagtggaagcttggcctgcggagacattcgacaaaaaaccgatggaaatgaatgtatctgtatctgaccttttctgcggagttaggggtttgaagcgtattctttccggcgttctagtgctttctattttggtggaattactttctattgccgtgcccgcagcgtcacaatttaccattgatacactagttcagtcatcggatcgtgaaggaatattttttatcgggatcgtagttatttctgcgttactgattaagtccacattttctgtgattcgagcttgggtactgatgagtcttcgttatacgcttggagtgaaatgggctgaaatgttctttaatcggcttagccgactgacgctaccattttttgaaaaacgtcacacaggtgatataacgtcacgttttcagtctctgactgccatccaagaagcttttacggctgatatggtagcgtctatactcgatgcaatggtcatcatcatctcaatggtcatcatttttactaattcacctctcttggcaatgggtccgctagctgcagctatgggatatgtcgccctgaaagcgggtctattttctatgtacagaacccgtaaaattgaacatattgcatttgaagcggttcagtcgtcccattttcttgagactattcgagctattagtgccatcaaaatgctgaatctggcaccgattcgtcggcgggagtgggtaaatcacgttgtcaacagcacacacgcaggaaaccaactattcaaacttgatcttttaaccaatacggcagccatgcttcttgttggtttttcgggtatctacgtgcttagcgtgggcgctttagagtttgataagggaataactactggcatattgttggcggtgatgctttatgctgacatggtgatcactcgtacagtgaggctagtaaacgcagtttctgacttttgtctggtatctatgcacagtcaacgcctgactgatattgctgtttcgcccgtagaacgggatgaaggggaaagatctcccgcccagttaaatggacatatagtgatccgaaacctatcgttccgtcattcaccaagcgaccccaacatctttgaaggcataaatattgaggttatgcctggggaaagcgtagccattattggaccatctggatgtggtaagtcaacgcttcttcatgtactagctgggctgtatgaacccactgatggtgatattttaattaacgggataagtatatccagtataggaaaacgagctatcaggaaacatgtcgcttttgtcatgcaagatgacaagttattagccggaaccctacagaaaaatatcactggattctcagagtcaccagatatggaacgtatggctgaatgtgccaattatgctgcaattgacgatgaaatttgctcatttccgcaggggtatgattcaatgattggagatatgggtagcactctttcaggaggacaacgccaacgcatttctatcgcaagggcgttatatcgccaacccagagttttgctgcttgatgaagcaacaagtgatctggatattgataacgaacgaaaaataactcatgctattagccaactaccaataactcgtattttcgttgctcatcgaccagaaatgattaaatcagcggatagaatctttaaccttcaattgaatgcatggatggagaaaaattgtggttctgtcgcattaagcggtcatcaggtaagcccccctgtttttgagtgagtccagaacgatgtccatggttaggaaactgaatgtctcttttatccccgtttcctaactgtaacgggtcgcaatcgaaaacggtcgagccgctacagctagggaatgggcgcaaatccccttaaccgaatgccattgtctggcgtagaacccctactgaagaaaacgttggcactgacacctgtaacaatccctatcgacaacattgcaccgccaatcatccaccaaaagtagcgctgaagccgatcataacgtcattggagatcgtcctctgcggccttgataattttcgcaataccatgactgcgttcagtcatctggtcaccgtaaaacggcctgaaaacgattttgagcggtttttgtatttcatgttcggatggtatttaaagagaaaaaaccgcacagtgaagctcgtaggcgtttttatgccatttagggtatggaggcggctcattcaatgtgactgggatagcggctcttcatccgccgatacaaaaggggggacttaatcagggaacgcgatccccctcatccctgctaagctgttttttagcgatctacccgtgactcgttcacccagttctccagaccgagaacgaccgtcatatgaaaatttgataaatacagcgtctggtctgggttcacggaacgtccatttcccatcaactgtttcatgaataattttcagatccatattatctccagtttagtgaagtgggaccgtggttccaaccatattttcaaactgtcattcttatatcgatgttagcaccgcaggcactggcataacgcgataatgttttcacactagcacccagaggattgccctctagtcgcgtgattgcggatggggatatgcccaattttttagctaattctgattttgacaacccagcgtgttcgcgcatttggtatagcatttcgacgatggtgagctcctgatcagcatcctgatatgcttgaatagctgctggggtatctagcatttctgccttcagttgttcgaaactgatactgttcattcgttcatctcctgtaaccgttttctcgctatttctatagagccagatggagttttttgtgtttttttcacaaatgcatgtaatagataaattttttgtcctatttcaaacgcatatagcgttctagctatgtttttagctccaacccgtagttcgaatagaccaccgccaataactctactgtgtggcatttttaattggtttccatccgcactcagtcgttctatcaatcggaacatgcgacctcgcagttcgtcaggtagctgcttcaattccaatagtgcatctggatgagttatcacatcaaacattttcccccctgattaaaatataccaaaaaaagaaatttccgtcaaagataaatttaactaaaaagataaatttatctaaaatatgcctgccattcctgaatcatcgcatctttgcaggttatccgcctgtctgaggatgggttttactgtgttgttgtgtatggtgagcacgaagcgatagagggtatgacacaatactggtgcctagaatctggagcatcacttccaacccataaaaatgatcatttatggaaggggtaatcgatgaaattcaatgaagattttttttatgaatggttgctggataagtcttccattaaacgtaattcaactaagcagaagattgcttactgtatggcctgcctgcttgagttgtctatcgaagacgaagggcaaaaagtaaaatctagccgtttatttgaacgtgcagacatcaataaagccgctcttcattacgctgtagggggaataaaaaatttgtgggaaattgacctctgattatgagcattgtctatccaaggaacaaaaatcagttattgacaatatcttctctgaagacggacaaaataaatccatgctggataacagtcgtatcgtcaaatgacacatgaccgcgttccgtgggttcatatcctgataccagtacgccacggtttttaattgccgttatgaattcagactccgttaaattaagcataaaaagtacccttaagaggattaaactaccttttacgagtaactgggttatagcgcccagaaacataaccagaatgcagaacattatgctaaaaaactagccagatccacaaatagccgccagatccacaaaatttaagccgaaaaactcaacgtaatcaaagtcttatggccaatttcacactctcagatccacactttttaggagagagaacctatatgatgtgaaaataggaaaaaacgcaatgcgcgtaatgtgcgcgcaatcgcggtgtccaacaaaattcactctatacgtgtctctcccctaaaaagtgtggatctgacggaaaaatcacgatggcaaaatgtggataactctatatatataaatattattaaataaaaataatatatatataacaggttgttgttgccaccgccgcgcagtgcgccgcaaaaatggttgtacaaataataatcaaattttgtggatctgagcgtggatctgcgtggatctgaggccgtccagatccacaacccgttggccacggcctcatagcccaaaagcagggtggtgcattgcgccaacggtgctcctattgtgagcgagttttgcgcgtttgtcaatcgcattgcgccatcggcgcggtttcttaaacaattcctaaacgagatgcagatttatgggattgggtcgggttagcgggacgcgcattgtgcgatgcgcgcgttgcgggcgggggagggtttggacggctgggtggctaggggcggcaggatgcttagtatgtttttatgtgtacaccgatgcttatagattttttttggttttttttatttttttgttttctaaaataaacataatacggtgatgtgatagtctgtggcatgaaatacgcattcgcattttcaatccatcataaaatgtctaaagtcgaattttttatcgcgcaatctaattcatacgacttcctgtggtgacacctggaagtcgattttgccctatccaattccattgaataatccggttttccgcaggagtccacggtcacctatttgccgattatgctgtattagcgctgtattagcgctgtattgcttattaccgtgatttgcaaacgtgatggcgttgccacaaatcgtctatggctgaatttgtccaggcctgaaataccttggtttttaatacgtcgcatgaggaagcggatgtacagcgaaagcattgtctttttgatcacaaaagtttctggagattgccggattgagtacgttttatcgcgctaagtgtggtttgggtgtttattatactgaatattgggcttctgtgcattcatcagatagtattatgtttttgctttggggtatcgtaatcgttttattatgctatttagggctataatgatagcctcaatacatttattatttgtctgagtcaatataattatgctcagtttgtgatgcatatcacttgcgctttgcgctaattgcgcttataaaccttgttatttgtgtgggtatcgatgttagtagttactaacatcaattttgcaggtttttggcgttttttcgcgccgttagcacattgtgcagcgctttgcgttaacggcgtattgggtggtctgtttagggtatgctacctatttttgcggattttttttttacagtttattattcttttccatctcgagattctctttcagggtttgtctgtcgttttccgagagtgcctcgattcgttttatggcattcatgacggttgatctatggacatcatttaatcggtcgtgtattaaatagttagaaggctcgctaaatatagttttcacgttcaatgaaagtgcctatcactttatcgtgcatttcttcagatttggaataaccgattgtttttctattcagcctttttattcgggtacgatgggtaaggttggttctctctatacgttgggtaaatatctttccagtaagatggacttcttcaggaagacaatcataaacggcataatcatccgtgcagtaaaaccggatattaaagggtgacaagagtgcccgtagtttttccaatgtttttctgctgcgatccccaaaagtatgtgccactatccgtttcatacgcggctcccaggcataccagagcccgcgctgatttttcttacgacccctgcttatccacttcacagataagatgaatgtcatccccgtcaagaggaagcgtcgtcacgttccgggggtgagtttttaaacgttttcatcacagtagctgttgccaccttcaatacgcgggccgtgtcacggatgccgctgttattcatcgccatatcaataatctgctctttgactcccggtttgcaggcttgataggtgtatgccaactgaaagactttactgcaggcatagcagcggtagcggggataacctctatgaccttttccatgtcctttgacatcttctgatttgtgacaataacgacaatcaacatctactttagccacgttccaccacgaaataccggaagattatcataacaactaactatttaatacatgaccaacactccggtatttagggagaattacccttgcaatcaagacgttatttcagaagcttttcgccatctttaagcctgataagtgtttgtacgaaaggaattctcctcttaagcagagtacaaatttttttggcaggcagtggtttatccaaaacatgaaacccaggttattagcggcttgggatagagccatgttggctaaacggttcatcatcgaaaccatcaatgatcagcttaagaacgtcacacaaattgagcattcccgccatcgtagtttgatgctgaatttattaggtggattaattgcttactgcttaaaacccaaaaagccatcactcaatatcacaagcgctgaaaaaacaggacttcgggtgatggcttaaactgatctcaggttaactagaaccgtgagactgacacgaaactttttcgtgcggtcgaggagttgaccgggttctgtccttagcgattgatacctatttctttgtcaaccaaggagacgtcgtgctccagaaaatgatatctgcaccgagataatcttctgcgaattctacaaactcgtccttgataaagggcttaccagtattggggttcctgtaggtcaaggtcggctcctgcactgccatggcaatgagtgctagcttacttttgtatttgttgaagaatggatatgagttcttcatttgcgccttgcggttgggaacaatatctgggccgccaagtccaatattattggcactcgcgaactcaaacagtcggcccatataattgtggtcgttgttccattcgcacggccagaaatttacatattggggttgtaagccggaaccgtccaaaattttgtcgggcttgtagctccggaagtagtggcgatgtgtgaaaattgtggccgctaccacacttggctacgttcaatgcgaaacatttggaatttttttagccaaaaaacccgtcacaagaaaagcaatttcgcgatggatttcattcctatttctgcttccgccatctttgcagataattccatcatctttattttcaccttcaagtaatcctatagcgcctgatttgcagacttgcatgaagctaaaatgcatagcatcagggatttcgacataggtcgagtaagttttcgagagatatttattcaagtagccggattcaagttcgaccggcatatctccaacatctgtgccagcgccaataataagagaagggatatgtatctttgccaaactctctgaggaaaaaccccggatcagtcctgcatcgagggaaataaacgcctttatgcgtgagtcttccatgtttctctccagttctggcttttcaagtccaagtactaaaacagggttgcaagcccagagagttgaatacttctggcagtcttttttaaacaatcctgtatcaaagcgtccaccgctaagggcaataacggtccatccaccaagagaatgaccaatagctgctattctttccatatcaaccttaccaccaagtttagagtctgtggttatagcgtcgatcactcgactcaagtcatgtggtcgttcccataactttgtggcttgttccatatctttgttaaatacacttgtaccgggatgatccggcgccgctacaatataaccctgaccggttaattcattggccagccaactcagattacgccaactaccaccatagccatgggaaagaaccaccagtggatattcgtcggaaccaggtactccattctgcacgacattaattccataaaaagtctgattgtcgccgatgtttatagttttggtttgatttttaacaggataccaaattgctacactcaatggcctgagttctcctttatctaggtcaatttctttaaaaccgaccgcagaggatgaatgagcaagcgcagaaatagataaccataatagactaactaaagaataaaatttaagcatgaatactccggataaactgatcatagctggatctattattactgagcataatctactcttaaatattatttgtacgcgcaagagtccgatagacggttggcctcgatactgaaaacagttcagccagatcgctgattgagtactcccccgttccgtgcatgcggcatagctctttctgttgcttatccgagagttttggttgtttacctcgtagttttccttttgcccgggcaatggccataccttcccgagtgcgcagccgtatcaaatctccctcgaactctgcgaaggtggccagtatattgaaaaacattttccccatcgggtctgtcggatcataaacactggggccaagtgccagtttgaccccacgagcaagcagtgagtcggcgatataacgagcatcaggaactgaacgggcaagtcggtctagttttggcacaaccagcgtatcgccgcagcgaacggctgcgagtgcctggtccagtcctggtctcaatcggtttgagccggttaacccctcgtcgatataaatccggtcaggggatacgccaagttggagtagcgcctcctgctgtgcagccaaatcctgtttgtctgttgagcaacgtgcataaccaatcaatgtttttgtcataaatatgtacgattaaggggccatcaaagagattgataccgtaccatttttatgagacaacttcagccgcgctgcatcattctataataattattttttactgttcgctgagcgatcctcttacggacatgaatttcctggagtcaacgtgatggctcatcatacaaacaaaataaccggtaaaagtgaaaggctgtctgtattaactgatgctgagcaagaagccttgtatggtttgcctgattttaacgatgcgcagaggctgcaattcctggcattgactgaattagaactggctcttgccaataatcgaccaagcctgcatgaccaactctattgcattcttcagattggttatttcaaagccaagcaggcttttttccgttttgactggcatgaggtcagtgacgattgcgctttcgtgataagccactacttccatgatgaatctttcgggagcgaactgatcactaaacatgaacgttacactcagcgtgagcaaattacccaattatttagctatcagtcttggtctggggaatttcggcctcagctcacacaacaagcggctcatatcgtgcggcgagatgcagccccgggttttgttgccgccgaattggtcatctggctcaaccaaaacaaaattgtccgacccggttacaccacactacaggatctggtcagccaggcgctttctgttgaacgccagcgtctgggaaatattctggccgatgttttggacgaaacggctacagccttactggataagctgctggtacgtgatgatacgttgtctcaactggcagtactcaggcaagatgctaaagatttcggctggcgtcagatggctcgagagcgtgaaaagcgtgctacgctgaaaccattgtatgaaattttcaaagtgttacaccccagattgggtatttcacagcagaacctactgcattacgcaagtttggtgaatttttacactatttacgatttgcgtaatctgaaaaccgatcaaacccggctctatttgctttgttatgcctggtggcgttatcggcagtttactgacaacctggttgatgcgatggcctttcatatgaagcaactggaggatgaaagccgagctatcgcaaaaaagaccttcgctgatgaacaagacaaacgtcatcaggagacttcacaggtgggtcgcctgctgtcattgtacgtcgatgatcgggtatctgatatgacaccgtttggtgaagtacgtcagcaagcctgggcaattatgccaagagacgcggtgcaaaatacagcacggcgtatgcgcgataagccactgaaaaaactggcactacactggcaatcagtagacaaattatctgggcgtgttcgccgccatttgcgtccgttgtataccgtgctggattttgcctgtattgatcctgccagtccatggcttaaagcgctcatctgggctaaagatatcttcagcaaaagacagcgtttttcgcaacggccgcttgctgaatgtccgccggcaacattaccaaagcggctgtgcccgtacctgctgatatttgacacggatggaaatccggctcatttgcacgccgaccgctatgaattctggctataccgtcagataagaaaacggtttcagtcaggcgaattttaccttgatggcagcctgcaacaccgccatctttccgacgagctggtttcaaatgaaaaaaagcgcgatgttctggcgcaaatggagatccctttcctacagcaacctgttgatgttttgctggataccctgtcatctgaattacatcaacaatggcaggttttcaatcacgaactgaaacaaggtcagcttaagcatctggaatacgataaggacacacagaaattacattggcgcaaacccaaggtggataatcgaaaacctcaagagcaaacattttatgcccagctgccgttctgcgatattgccgatgtactcagtttcgtgaatgaacagtgccattttctatcagtaatgaaacctttacagccacgttatgcgaaaaaacaagccgaaactgatagtctgatggccgtcattattgcccaggccatgaaccacggtaatcaggtgatgtcgcgaaccagtgatattccctaccacattctggaaaatacttaccagcagtatctgcgtcaggcgacattacaggccgccaatgactgcatcagtaatgcgattgccacactgcctatctttccgcattattcgtttgatcttgacgttctgtacggtgcggtcgatggacagaaattcggggttgagcatacaactgtgaaagcccgctattcacgtaaatattttgggcgtggcaaaggtgtagtcgcctacacgctattgtgtaaccatatacctctcaacggctatctgataggcccaaacgaatatgaggcttaccatgtctttgatatctggtatcgcaacacctcgaatatcgtgccaaccgccatcaccggtgatatgcacagtgttaataaggctaacttcgcgatccttcactggtttggcctgcgttttgagcctcgtttcaccagtctgaatgcacaactacagatgttgtattgtgctaatgacccggaaatgtacaaaaaatgcctgattcaacccgtcggccagattgaccggcaacttattatccgcgaaaaagccaatattgaccggattgttgccacgttggggttgaaagaaatgacacaaggtctgcttattcgtaagctgtgtacttatacggcacccaatccaacgcgacgcgctatctttgagtatgatcggttggtacgcagcctctacacattgcgttacctgcgtgatcctcagttagaacggaatgtacaccgctcacagaaccggcttgaatcttatcatcaactccgttcagccatcgcacaggtcggcggcaaaaaggaactcaccggacgaaccgacatcgaaacggaaatcagtaatcagtgtgggcgattggttgctaacgcaatcatctactataactccgcgattttatcccggttactgaataaaccggaggtatcagacagcatcaagacactggcattgataaccaaaatgccccccgtcgcctggcagcatattttgctgaacgggcattataccttccagaacgaaggtaaaattattgaccttgatgcgcttatagcagggctgaatttcggctgacggaattttcggcggttccggcttagaatcccttatagttaatgagatctttactcattaatgtgtcgcctataatccatagattgatgtagaattctgacaatggttatcccattttccactacacgaaaaaagataatgtgtgaagctattgggaatccctttaacccagatctaaggcactgattatcagcgctaagtgacactttccgctctattccttcattgatccatgtatccagcaaggctttcagctccttccatgcctgacacatataatggtttgtggctatttatgacacaggtgtcattttcagaagacgattgcacggaatgtcagaagtcgtcttctgaaaatgacaatcgtattgtccgacacacgttgatttatcggacaaaaacccttaacgtgtgaaaccgttccactgagcgtcaaaccccgtttatagcagaccgttcaggtgcaagtgactatggtattagaggtatcacttcaatggtttggtcagacaaagagcctccattattcatcagtgtctatcttagaaaaagtaacacttctcttgaagaacgttcagagaaaattgctgagattgggatggttatttttagcaagtatactcactaaacgactaccggctgatgccggtaggtttatcggcatggttttcgatacactgaagtataattttgtccgtgacattgcaaccggcagagatattttatcgattgactgcataaagagtcatcatttccacctccgcacaaattttctctgttaatgcgagcgtgtgaggaaatcgcggatggccgtcgcaatctcactggcatgggtttccaaggcgaagtgaccggtttcaaagaaggtgacttttgcctcggggatatcgcgcttgaacgcttcagcaccaagtggcaagaaaaacggatcgtttcggccccacaccgcaaggaagggtggtttgtgagtgcggaaatattcctgaaaattcggatagagggcgacgttgcttttgtagtcgcctaatagatcgagttgcacatcagcggcgccggggcgagtcagataatagttgtcgaggttttgcccgtccggagagatggccgtctcatcgggaacaccgtaagtatattgccagtttgtggtctcgggagcgaggaaggcacgcagtgcatcgcggttggcctgagaggcgtcctgccaataggccctgattgggttccagccttcactcaacccttcttcataggcattaccgttctgcgaaatgatgcctgtaatccgttcgggatgccacatagcaagccggaagccagtcggcgcgccgtagtcaaacacataaacagcgaaccggtcaaagcagaccacatcggtgaatcggtcgatgaccttggcaatgttatcgaaggtgtatttgaacgcaccgcgtgccggcatgtcggactggccaaaccctggtaagtcgggcgcgatgatgtggaagcgatcggccagcaacggaatcaagtccctgaacatatggccggcactcggaaagccgtgcaacagtaggagctttggagcgtcagctcgaccggcctcgcgatagaaaatcttgaagccatctacgtcggcgctctgatagcagatcgtgttcattgtgatatcctcactatggaatttcagggtttggtacaattttttgtagggttgcgtggcaagttcagtcgattgttgccttaaatttcttttaatttcctatatttgcttacaatatccataatattgcctgagccgattggcgaggtacgtcatttgagccggtcggcaaggcgcatcagcaaatccatgcgctcgtgaaaaatagccacgattaacgcaggcgcattttcacgcggcagacaaaacacatagtgatgttcacaatgcgccatgcgcaatgccggaaagagcgcgctcatgtccttaaaagagccttggccgacagcaagccgcgcgatgccctgttccagcgcggtgacgtagcggcgcacctgcacgtcaccccattgtttgcgcgtatggcggatgattgcgcgtaaatcggcctcagccgccttcgtgagtacatagtccatcaagcgcggtcgctcccggcaagttcttcatcgagaattgcgccgatgcttttcccgcacaccttcccctccatcccttcattgatgcgtgtatccagcaaggctttcagatcctgccatgcctgatcgctatcgctcattccggggaacaggcgttcgagtgcgtattgcttgatcgtcttgccttgcagggcggccaatgccttcaggctttggtgctgccggtcggtgatgtcgatggtcagacggctcatggttttctccttatcggtcatacacaaacccacattagcacatataatggtttgtggctatttattaaacaatggtcagatatcgttttgtccggcaaacgaccgtttgacggtcatgacggacatctgtccgaaaacatcttgatgaatgggatttcggacattatgatagatggacgcaataacggacaaatggggtgaacgatggcactgatcggctatgcacgggtctcaacaatagaacagaacacagccttgcagacggatgcactgcacaaggccgggtgcgaacgggttttcgaggacaggtgttcaggtgcaaaaagcgaccgccggtaga
